US011224621B2

(12) United States Patent
Duportet et al.

(10) Patent No.: US 11,224,621 B2
(45) Date of Patent: Jan. 18, 2022

(54) MODULATION OF MICROBIOTA FUNCTION BY GENE THERAPY OF THE MICROBIOME TO PREVENT, TREAT OR CURE MICROBIOME-ASSOCIATED DISEASES OR DISORDERS

(71) Applicant: Eligo Bioscience, Paris (FR)

(72) Inventors: Xavier Duportet, Paris (FR); Antoine Decrulle, Paris (FR); Cristina del Carmen Gil-Cruz, St. Gallen (CH); Christian Ivan Pérez-Shibayama, St. Gallen (CH); Burkhard Ludewig, St. Gallen (CH); Jesus Fernandez Rodriguez, Paris (FR); Andreas Brodel, Paris (FR)

(73) Assignee: ELIGO BIOSCIENCE, Paris (FR)

( * ) Notice: Subject to any disclaimer, the term of this patent is extended or adjusted under 35 U.S.C. 154(b) by 0 days.

(21) Appl. No.: 17/225,869

(22) Filed: Apr. 8, 2021

(65) Prior Publication Data

US 2021/0315944 A1 Oct. 14, 2021

Related U.S. Application Data

(60) Provisional application No. 63/007,191, filed on Apr. 8, 2020, provisional application No. 63/132,190, filed on Dec. 30, 2020, provisional application No. 63/137,998, filed on Jan. 15, 2021, provisional application No. 63/137,989, filed on Jan. 15, 2021.

(51) Int. Cl.
  *C12N 15/70* (2006.01)
  *A61K 35/74* (2015.01)
  *C12N 15/90* (2006.01)
  *C12N 15/74* (2006.01)

(52) U.S. Cl.
  CPC .............. *A61K 35/74* (2013.01); *C12N 15/70* (2013.01); *C12N 15/74* (2013.01); *C12N 15/902* (2013.01)

(58) Field of Classification Search
  CPC ................................. C12N 15/70; C12N 15/74
  See application file for complete search history.

(56) References Cited

U.S. PATENT DOCUMENTS

| | | | |
|---|---|---|---|
| 5,863,560 | A | 1/1999 | Osborne |
| 7,482,115 | B2 | 1/2009 | Scott et al. |
| 2011/0218216 | A1 | 9/2011 | Vivek et al. |
| 2015/0064138 | A1 | 3/2015 | Lu et al. |

FOREIGN PATENT DOCUMENTS

| | | |
|---|---|---|
| WO | WO2014124226 A1 | 8/2014 |
| WO | WO2017009399 A1 | 1/2019 |
| WO | WO2020181178 A1 | 9/2020 |
| WO | WO2020181180 A1 | 9/2020 |
| WO | WO2020181193 A1 | 9/2020 |
| WO | WO2020181195 A1 | 9/2020 |
| WO | WO2020181202 A1 | 9/2020 |

OTHER PUBLICATIONS

Jiang et al. 2013; RNA-guided editing of bacterial genomes using CRISPR-Cas systems. Nature Biotechnology. 31(3): 233-239, plus 2 pages of Online Methods.*
Sheth et al. 2017; Manipulating bacterial communities by in situ microbiome engineering. Tends Genet. 32(4): 189-200.*
Voorhees et al. 2020; Challenges & opportunities for phage-based in situ microbiome engineering in the gut. Journal of Controlled Release.326:106-119.*
Ramachandran et al. 2019; Editing the microbiome the CRISPR way. Phil. Trans. R. Soc. B 374:20180103; pp. 1-10.*
Gil-Cruz et al. 2019; Microbiota-derived peptide mimics drive lethal inflammatory cardiomyopathy. Science. 366:881-886 plus Supplemental Materials pp. 1-34.*
Abudayyeh ey al., RNA targeting with CRISPR-Cas13a, Nature. Oct. 12, 2017; 550(7675): 280-284.
Anne et al., Protein Secretion in Gram-Positive Bacteria: From Multiple Pathways to Biotechnology, Springer International Publishing Switzerland 2016, Current Topics in Microbiology and Immunology, 1-42.
Anzalone et al., Search-and-replace genome editing without double-strand breaks or donor DNA, Nature. Dec. 2019; 576(7785): 149-157.
Camprubi-Font et al., Genetic and Phenotypic Features to Screen for Putative Adherent-Invasive *Escherichia coli*, Frontiers in Microbiology, Feb. 21, 2019, vol. 10, Article 108, 1-11.
Camprubi-Font et al., Amino Acid Substitutions and Differential Gene Expression of Outer Membrane Proteins in Adherent-Invasive *Escherichia coli*. Frontiers in Microbiology, Aug. 6, 2019, vol. 10, Article 1707, 1-10.
Chen et al., Precise and programmable C:G to G:C base editing in genomic DNA, bioRxiv preprint doi: https://doi.org/10.1101/2020.07.21.213827; this version posted Jul. 21, 2020, 1-19.
Chen et al., Programmable C:G to G:C genome editing with CRISPR-Cas9-directed base excision repair proteins, Nature Communications | (2021) 12:1384 | https://doi.org/10.1038/s41467-021-21559-9 | www.nature.com/naturecommunications, 1-7.

(Continued)

*Primary Examiner* — Karen Cochrane Carlson
(74) *Attorney, Agent, or Firm* — Arrigo, Lee, Guttman & Mouta-Bellum LLP

(57) ABSTRACT

The invention encompasses compositions, kits and methods for modifying bacteria, preferably naturally occurring bacteria, in situ. These can be used to treat, prevent or cure microbiome-associated diseases or disorders by modulating the molecules expressed and/or secreted by bacterial populations of the microbiome in a specific manner. The genomic modifications can modify the interactions between part or all of these populations and the host in a way that decreases their deleterious potential on host health. The compositions, kits and methods of the invention do not result in the direct death of these populations or a direct significant inhibition of their growth. The invention further includes methods for screening for genetic modifications in the bacteria, for determining the efficiency of vectors at inducing these genetic mutations, and for determining the effects of these mutations on bacterial growth.

19 Claims, 14 Drawing Sheets

Specification includes a Sequence Listing.

(56) References Cited

OTHER PUBLICATIONS

Costa et al., Secretion systems in Gram-negative bacteria: structural and mechanistic insights, Nature Reviews | Microbiology vol. 13 | Jun. 2015 | 343-359.
Cox et al., RNA Editing with CRISPR-Cas13, Science. Nov. 24, 2017; 358(6366): 1019-1027.
Del Solar et al., Replication and Control of Circular Bacterial Plasmids, Microbiology and Molecular Biology Reviews, vol. 62, No. 2 Jun. 1998, p. 434-464.
Dreux et al., Point Mutations in FimH Adhesin of Crohn's Disease-Associated Adherent-Invasive *Escherichia coli* Enhance Intestinal Inflammatory Response, PLoS Pathog 9(1): e1003141, 1-17, Published Jan. 24, 2013.
Farzadfard et al., Genomically Encoded Analog Memory with Precise In vivo DNA Writing in Living Cell Populations, Science. Nov. 14, 2014; 346(6211), 1-18.
Fillol-Salom et al., Phage-inducible chromosomal islands are ubiquitous within the bacterial universe, The ISME Journal (2018) 12:2114-2128.
Fonfara et al., Phylogeny of Cas9 determines functional exchangeability of dual-RNA and Cas9 among orthologous type II CRISPR-Cas systems, Nucleic Acids Research, 2014, vol. 42, No. 4 2577-2590.
Garcia et al., Peripheral tolerance to insulin is encoded by mimicry in the microbiome, bioRxiv preprint first posted online Dec. 19, 2019; doi: http://dx.doi.org/10.1101/2019.12.18.881433, 1-14.
Gaudelli et al., Programmable base editing of A•T to G•C in genomic DNA without DNA cleavage, Nature. Nov. 23, 2017; 551(7681): 464-471.
Gil-Cruz et al., Microbiota-derived peptide mimics drive lethal inflammatory cardiomyopathy, Science 366, 881-886 (2019).
Greiling et al., Commensal orthologs of the human autoantigen Ro60 as triggers of autoimmunity in lupus, Sci Transl Med. Mar. 28, 2018; 10(434), 1-33.
Grunewald et al., A dual-deaminase CRISPR base editor enables concurrent adenine and cytosine editing, Nat Biotechnol. Jul. 2020; 38(7): 861-864.
Henkel et al., Toxins from Bacteria, EXS. 2010 ; 100: 1-29.
Jinek et al., A programmable dual RNA-guided DNA endonuclease in adaptive bacterial immunity, Science. Aug. 17, 2012; 337(6096): 816-821.
Karberg et al., Group II introns as controllable gene targeting vectors for genetic amnipulation of bacteria, Nature Biotechnology, vol. 19, Dec. 2001, 1162-1167.
Komor et al., Programmable editing of a target base in genomic DNA without double-stranded DNA cleavage, Nature. ; 533(7603): 420-424, available in PMC Oct. 20, 2016.
Koonin et al., Diversity, classification and evolution of CRISPR-Cas systems, Curr Opin Microbiol. Jun. 2017 ; 37: 67-78.
Krupovik et al., A classification system for virophages and satellite viruses, Arch Virol (2016) 161:233-247.
Kues et al., Replication of Plasmids in Gram-Negative Bacteria, Microbiological Reviews, Dec. 1989, vol. 53, No. 4, p. 491-516.
Kurt et al., CRISPR C-to-G base editors for inducing targeted DNA transversions in human cells, Nat Biotechnol. Jan. 2021 ; 39(1): 41-46.
Li et al., Targeted, random mutagenesis of plant genes with dual cytosine and adenine base editors, Nature Biotechnology vol. 38, pp. 875-882 (2020).
Maini Rekdal et al., Discovery and inhibition of an interspecies gut bacterial pathway for Levodopa metabolism, Science 364, 1055 (2019) Jun. 14, 2019, 1-11.
Makarova et al., Evolutionary classification of CRISPR-Cas systems: a burst o, f class 2 and derived variants, Nature Reviews Microbiology vol. 18, pp. 67-83 (2020).
Massip et al., Deciphering the interplay between the genotoxic and probiotic activities of *Escherichia coli* Nissle 1917, PLoS Pathog 15(9): e1008029, 1-24, Published: Sep. 23, 2019.
Meric et al., Disease-associated genotypes of the commensal skin bacterium *Staphylococcus epidermidis*, Nature Communications, (2018) 9:5034, 1-11.
Myers et al., Optimal alignments in linear space, CABIOS, vol. 4, No. 1. 1988, pp. 11-17.
Needleman et al., A General Method Applicable to the Search for Similarities in the Amino Acid Sequence of Two Proteins, J. Mol. Biol. (1970) 48, 443-453.
Negi et al., Gut bacterial peptides with autoimmunity potential as environmental trigger for late onset complex diseases: In-silico study, PLoS ONE 12(7): e0180518, Published Jul. 5, 2017.
Rees et al., Base editing: precision chemistry on the genome and transcriptome of living cells, Nat Rev Genet. Dec. 2018 ; 19(12): 770-788.
Ruff et al., Pathogenic Autoreactive T and B Cells Cross-React with Mimotopes Expressed by a Common Human Gut Commensal to Trigger Autoimmunity, Cell Host & Microbe 26, 100-113, Jul. 10, 2019.
Sharon et al., Functional genetic variants revealed by massively parallel precise genome editing, Cell. Oct. 4, 2018; 175(2): 544-557.
Simon et al., Retrons and their applications in genome engineering, Nucleic Acids Research, 2019, vol. 47, No. 21 11007-11019, Published online Oct. 10, 2019.
Tam et al., *Staphylococcus aureus* Secreted Toxins & Extracellular Enzymes, Microbiol Spectr. Mar. 2019 ; 7(2):1-59.
Tomida et al., Pan-Genome and Comparative Genome Analyses of Propionibacterium acnes Reveal Its Genomic Diversity in the Healthy and Diseased Human Skin Microbiome, mBio 4(3):e00003-13. doi:10.1128/mBio.00003-13, May/Jun. 2013.
Wang et al., Lysis Timing and Bacteriophage Fitness, Genetics 172: 17-26 (Jan. 2006).
Wannier et al., Improved bacterial recombineering by parallelized protein discovery, bioRxiv preprint doi: https://doi.org/10.1101/2020.01.14.906594, uploaded on Feb. 26, 2020.
Weigele et al., Biosynthesis and Function of Modified Bases in Bacteria and Their Viruses, Chem. Rev. 2016, 116, 12655-12687, Published: Jun. 20, 2016.
Yan et al., Cas13d is a compact RNA-targeting type VI CRISPR effector positively modulated by a WYL domain-containing accessory protein, Mol Cell. Apr. 19, 2018; 70(2): 327-339.
Zhao et al., New base editors change C to A in bacteria and C to G in mammalian cells, Nature Biotechnology vol. 39, pp. 35-40 (2021).
Zimmerman et al., Mapping human microbiome drug metabolism by gut bacteria and their genes, Nature. Jun. 2019 ; 570(7762): 462-467.
Zou et al., A SNP of bacterial blc disturbs gut lysophospholipid homeostasis and induces inflammation through epithelial barrier disruption, EBioMedicine 52(2020)102652, 1-17.
Bikard et al., Exploiting CRISPR-Cas nucleases to produce sequence-specific antimicrobials, Nature Biotechnology, vol. 32, No. 11, 1146-51, Nov. 2014.
Brezgin et al., Dead CasSystems: Types, Principles, and Applications, INternational Journal of Molecular Sciences 2019, 20, 6041, 1-26, Nov. 30, 2019.
Cobb et al., CRISPR-Cas9 modified bacteriophage for treatment of *Staphylococcus aureus* induced osteomyelitis and soft tissue infection, PLOS ONE14(11):e0220421, 1-17, Nov. 22, 2019.
Huss et al.,Engineered bacteriophages as programmable biocontrol agents, Current Opinion in Biotechnology 2020, 61, 115-121, Dec. 17, 2019.
Lam et al.,Phage-delivered CRISPR-Cas9 for strain-specific depletion and genomic deletions in the gut microbiota, bioRxiv, doi.org/10.1101/2020.07.09.193847, 1-60, Jul. 9, 2020.
Park et al., Genetic engineering of a temperate phage-based delivery system for CRISPR/Cas9 antimicrobials ahgainst *Staphylococcus aureus*, Scientific Reports 7:44929, 1-12, Mar. 21, 2017.
European Patent Offfice, International Search Report, PCT/EP2021/059229, dated Jul. 19, 2021.

\* cited by examiner

MODULATION OF MICROBIOTA FUNCTION BY GENE THERAPY OF THE MICROBIOME TO PREVENT, TREAT OR CURE MICROBIOME-ASSOCIATED DISEASES OR DISORDERS

REFERENCE TO SEQUENCE LISTING SUBMITTED ELECTRONICALLY

The instant application contains a Sequence Listing which has been submitted electronically in ASCII format and is hereby incorporated by reference in its entirety. Said ASCII copy, created on Apr. 8, 2021, is named EB2020-02_US-reg_Sequence_listing.txt and is 629,761 bytes in size.

CROSS REFERENCE TO RELATED APPLICATIONS

This application claims the benefit of U.S. application 63/007,191 filed Apr. 8, 2020, U.S. application 63/132,190 filed Dec. 30, 2020, U.S. application 63/137,998 filed Jan. 15, 2021, and U.S. application 63/137,989 of Jan. 15, 2021, all of which are herein incorporated by reference in their entirety.

TECHNICAL FIELD

The present invention relates to compositions, kits and methods for modifying bacteria, preferably naturally occurring bacteria, in situ.

BACKGROUND OF THE INVENTION

The human microbiota comprises bacteria, archaea, viruses, and microbial eukaryotes living in our bodies. The taxonomic composition of these communities has been extensively studied and is significantly associated with a variety of diseases and traits. This microbiota indeed consists of thousands of different bacterial species that carry hundreds of billions of genes, which is called the microbiome. This microbiome encodes for a variety of molecules (proteins, lipids, sugars, RNA, etc.) and functions that are essential and beneficial for their host, for instance the enrichment of glycans metabolism, amino acids and xenobiotics but also the regulation of our immune system. It is also responsible for the synthesis of vitamins, isoprenoids and other nutrients which results in human overall metabolism representing an amalgamation of microbial and human attributes.

Widespread deployment of sequencing technologies has revealed that most bacterial species harbor extensive genetic variation not only between hosts, but often within a host over time, and even within a host at a given time.

Isolation and sequencing of numerous strains highlight the genetic heterogeneity within a single bacterial species. Between different strains within a single bacterial species, this variation comprises single-nucleotide variants, short insertions and deletions (indels), and larger structural variants, which include duplications, deletions, insertions, inversions but also horizontal gene transfer such as prophage or plasmid acquisition and recombination events with such exogenous DNA.

Due to such variations, such strains, when co-existing in a single host, often compete with each other for their existence in a specific microbiome niche.

Interestingly, there is a growing body of recent studies based on metagenome sequencing that demonstrate that the presence of specific strains (and therefore of specific genetic signatures in the microbiome) can be directly linked to a number of pathologies, including autoimmunity, infections, inflammation, neurodegenerative diseases or tumorigenesis.

To treat microbiome-associated diseases or disorders, current approaches try to remove unwanted bacteria (and therefore the deleterious genes they carry) by using subtractive methods such as antibiotics, replicative phages, lysins, which result in the killing of deleterious bacteria but also non-deleterious bacteria.

While such strategies have proven to be beneficial on the short term by significantly reducing the load of entire bacterial populations, it can both:

induce a strong dysbiosis and indirectly lead to the short-term overgrowth of non-targeted deleterious bacterial species or strains. For example, bacteria such as *Clostridium difficile* are known to fill the bacterial void created by antibiotic treatment. Thus, the killing of a particular targeted species or strain of bacteria within the microbiome can create a void that can be filled by harmful bacteria both in the short-term and in the long term. These bacteria can be of the same or a different species as the targeted species.

lead to the emergence of antimicrobial resistance in the long term and therefore become inefficient in excluding the species or strain(s) carrying the genetic elements associated with the pathology. For example, antibiotic use has been associated with the replacement of antibiotic-sensitive strains of *Staphylococcus aureus* with antibiotic-resistant strains of *Staphylococcus aureus*. Therefore, The durable elimination of an engrafted bacterial population in the microbiome can be challenging to achieve, as the microbiome is naturally in a state of equilibrium with different populations (strain or species) occupying different geographic and metabolic niches. A non-specific treatment like an antibiotic typically leads to a return to the equilibrium that existed before treatment after a few weeks or months. On occasion, the equilibrium will be perturbed for longer periods of time and a dysbiosis can occur. A targeted elimination of a population by phage therapy (wild-type phages to engineered phages, packaged phagemids), lysins, antimicrobial peptides, or any other targeted killing approaches can be equally challenging as targeted bacterial survivors will tend to quickly regrow to occupy the niche that was left empty.

The durable elimination of a bacterial population in the microbiome can be challenging to achieve, as the microbiome is naturally in a state of equilibrium with different populations (strain or species) occupying different geographic and metabolic niches. A non-specific treatment like an antibiotic typically leads to a return to the equilibrium that existed before treatment after a few weeks or months. On occasion, the equilibrium will be perturbed for longer periods of time and a dysbiosis can occur. A targeted elimination of a population by phage therapy (wild-type phages to engineered phages, packaged phagemids), lysins, antimicrobial peptides, or any other targeted killing approaches can be equally challenging as targeted bacterial survivors will tend to quickly regrow to occupy the niche that was left empty.

For these reasons, the genetic modification of a target bacterial population in-situ whether at the strain or species level, can be an interesting alternative. It can lead to the modification of a deleterious population to remove its deleterious effect without killing the target bacteria, and in some cases even without affecting its fitness therefore not disturbing the equilibrium of the ecosystem.

In this way, no void would be created that could be filled by harmful bacteria nor would it lead to treatment resistance. Such an approach would represent a very powerful and elegant approach to treat, prevent or cure a number of microbiome-associated diseases or disorders, especially in the case of long term or chronic pathologies. The invention fulfills this need.

BRIEF SUMMARY OF INVENTION

The invention relates to methods, kits and compositions for modifying a naturally occurring bacteria in situ. In one embodiment, the method, in particular the non-therapeutic method, comprises genetically modifying a DNA sequence in the naturally occurring bacteria in situ without introducing a double strand break in the DNA sequence. Preferably, the genetic modification does not lead to the death of bacteria.

In one embodiment, the method, in particular the non-therapeutic method, comprises contacting said naturally occurring bacteria with a vector encoding enzymes or systems for inducing genetic modifications. The invention also concerns a vector encoding enzymes or systems for inducing genetic modifications, for use in a therapeutic method of modifying a naturally occurring bacteria in situ and/or in vivo.

In one embodiment, said vector further comprises a conditional origin of replication which is inactive in the targeted bacteria but is active in a donor bacterial cell. In a particular embodiment, said conditional origin of replication is an origin of replication, the replication of which depends upon the presence of a given protein, peptid, nucleic acid, RNA, molecule or any combination thereof. In a particular embodiment, said conditional origin of replication is active in said donor bacterial cell because said donor bacterial cell expresses said given protein, peptid, nucleic acid, RNA, molecule or any combination thereof. In a particular embodiment, said conditional origin of replication is an origin of replication derived from phage-inducible chromosomal islands (PICIs). In a particular embodiment, said conditional origin of replication is active in said donor bacterial cell because said donor bacterial cell expresses a rep protein, in particular a primase-helicase. In a particular embodiment, said conditional origin of replication is derived from the origin of replication from the PICI of the *Escherichia coli* strain CFT073. In a particular embodiment, said conditional origin of replication comprises or consists of the sequence SEQ ID NO: 7 or SEQ ID NO: 8.

In one embodiment, said vector is devoid of an antibiotic resistance marker.

In one embodiment, said vector is located inside a delivery vehicle that allows the transfer of the vector into bacteria, more particularly inside a bacterial virus particle. In one embodiment, the method comprises contacting said naturally occurring bacteria with a vector located inside a delivery vehicle that allows the transfer of the vector into bacteria. Preferably, the vector located inside a delivery vehicle is a phagemid and, preferably, the delivery vehicle is a bacterial virus particle or a capsid.

In a particular embodiment, said vector is inside a bacterial virus particle, more particularly is in the form of a packaged phagemid. In one embodiment, the method comprises transducing said naturally occurring bacteria with a packaged phagemid. Preferably, the phagemid comprises a nucleic acid sequence encoding a modified nuclease that is modified to be unable to perform DNA double strand break while retaining its DNA binding capacity and that is fused to a domain to perform other types of function, such as for instance a domain to perform base editing. Preferably, the phagemid comprises a nucleic acid sequence encoding a nuclease that is an RNA guided nuclease. Preferably, the phagemid comprises a nucleic acid sequence encoding a dCas9 (dead-Cas9) or nCas9 (nickase Cas9). In one embodiment, the phagemid comprises a nucleic acid sequence encoding a dCas9 and a deaminase domain, or a nCas9 and a deaminase domain.

In one embodiment, the genetic modification is at least one point mutation(s).

In one embodiment, the genetic modification is at least one insertion or at least one deletion.

In one embodiment, the genetic modification is at least one point mutation(s), insertion and/or deletion inside a coding sequence leading to a frameshift mutation.

In one embodiment, the bacteria with the genetic modification does not have a reduced in vivo growth rate and/or fitness as compared to the same bacteria without the genetic modification.

In one embodiment, the genetic modification is in a bacterial toxin gene. In one embodiment, the genetic modification is in the ClbP gene in pks+ *E. coli* and results in a single amino acid mutation and the inactivation of the genotoxic activity of Colibactin toxin, but maintains the antagonistic activity. Preferably, the genetic modification is at S95 or K98 of the ClbP gene. More preferably, the genetic modification is selected from the group consisting of S95A, S95R and K98T[1].

In one embodiment, the genetic modification is in the *Bacteroides faecis* or *Bacteroides thetaiotaomicron* beta-galactosidase gene, said beta-galactosidase gene being typically of sequence SEQ ID NO: 2323, and typically encoding a protein of sequence SEQ ID NO: 2322. Preferably, the *Bacteroides faecis* or *Bacteroides thetaiotaomicron* beta-galactosidase protein with the genetic modification shows lower homology with human MYH6 cardiac peptide, said human MYH6 cardiac peptide being typically of sequence SEQ ID NO: 2324, as compared to the *Bacteroides faecis* or *Bacteroides thetaiotaomicron* beta-galactosidase protein without the genetic modification[2].

In one embodiment, the method comprises genetically modifying at least one DNA sequence or gene in the naturally occurring bacteria in situ in a subject, in particular in a human. In one embodiment, the method comprises modulating host-microbiome interaction by genetically modifying naturally occurring bacteria in situ wherein said naturally occurring bacteria is involved in microbiome associated disorder or disease.

In one embodiment, the method comprises genetically modifying a DNA sequence responsible for a microbiome associated disorder or disease in the naturally occurring bacteria in situ without introducing a double strand break in the DNA sequence. In one embodiment, the genetic modification reduces the effects of the microbiome associated disorder or disease, and the genetic modification does not lead to the death of bacteria. Preferably, the bacteria with the genetic modification does not have a reduced in vivo growth rate as compared to the same bacteria without the genetic modification.

In one embodiment, the method is to prevent or intervene in the course of an auto-immune disease or reaction in a predisposed host by modifying the immunogenic profile of a bacterial population of the host microbiome. In one embodiment, the method comprises contacting the bacterial population with a vector that generates a genetic modification in a DNA sequence coding for an immunogenic component expressed or secreted by the bacteria in at least some of the bacteria of said population without cleaving the DNA sequence. The invention also concerns a vector generating a genetic modification in a DNA sequence coding for an immunogenic component expressed or secreted by bacteria in at least some of the bacteria of a bacterial population of a host microbiome without cleaving the DNA sequence, for use to prevent or intervene in the course of an auto-immune disease or reaction in a predisposed host, wherein said vector modifies the immunogenic profile of said bacterial population. Preferably, the genetic modification of the DNA sequence coding for the immunogenic component results in loss of the immunogenic effect of said immunogenic component, wherein said genetic modification does not lead to the direct death of the bacteria. Preferably, the genetic modification of the DNA sequence coding for the immunogenic component results in the inability of the immune system to recognize the immunogenic component. Preferably, the bacteria with the genetic modification does not have a reduced in vivo growth rate as compared to the same bacteria without the genetic modification.

In one embodiment, the method comprises contacting said naturally occurring bacteria with a vector encoding enzymes or systems for inducing genetic modifications.

In one embodiment, said vector further comprises a conditional origin of replication which is inactive in the targeted bacteria but is active in a donor bacterial cell. In a particular embodiment, said conditional origin of replication is an origin of replication, the replication of which depends upon the presence of a given protein, peptid, nucleic acid, RNA, molecule or any combination thereof. In a particular embodiment, said conditional origin of replication is active in said donor bacterial cell because said donor bacterial cell expresses said given protein, peptid, nucleic acid, RNA, molecule or any combination thereof. In a particular embodiment, said conditional origin of replication is an origin of replication derived from phage-inducible chromosomal islands (PICIs). In a particular embodiment, said conditional origin of replication is active in said donor bacterial cell because said donor bacterial cell expresses a rep protein, in particular a primase-helicase. In a particular embodiment, said conditional origin of replication is derived from the origin of replication from the PICI of the *Escherichia coli* strain CFT073. In a particular embodiment, said conditional origin of replication comprises or consists of the sequence SEQ ID NO: 7 or SEQ ID NO: 8.

In one embodiment, said vector is devoid of an antibiotic resistance marker.

In one other embodiment, said vector comprises an auxotrophic marker.

In one embodiment, said vector is located inside a delivery vehicle that allows the transfer of the vector into bacteria, more particularly inside a bacterial virus particle.

In one embodiment, the method comprises contacting said naturally occurring bacteria with a vector located inside a delivery vehicle that allows the transfer of the vector into bacteria.

Preferably, the delivery vehicle with the vector is a packaged phagemid.

In a particular embodiment, said packaged phagemid comprises a phagemid encoding an enzyme that modifies the genome of said bacterial. Preferably, said enzyme is a base editor or a prime editor.

In one embodiment, the method comprises transducing said bacteria with a packaged phagemid comprising a phagemid encoding an enzyme that modifies the genome of said bacteria. Preferably, the method comprises transducing said bacteria with a packaged phagemid comprising a phagemid encoding an enzyme that is a base editor. Preferably, the method comprises transducing said bacteria with a packaged phagemid comprising a phagemid encoding an enzyme that is a prime editor.

In one embodiment, the modification is at least one point mutation(s) in a protein-encoding nucleic acid sequence that results in a change of amino acid in a mimic peptide and renders the mimic peptide not immunogenic i.e. not recognized by the immune system.

In one other embodiment, the genetic modification results in a change of sugar profile on the bacterial membrane.

In one other embodiment, the genetic modification results in a change of amino acid in a protein sequence that in turn results in a change of sugar profile on the bacterial membrane In one other embodiment, the genetic modification results in a change of lipid profile on the bacterial membrane.

In one other embodiment, the genetic modification results in a change of amino acid in a protein sequence that in turn results in a change of lipid profile on the bacterial membrane.

In one embodiment, the genetic modification renders a catalytic site inactive. In one embodiment, the genetic modification renders a binding site with a human cell receptor non-functional.

In one embodiment, the genetic modification is a point mutation(s) that results in a change of amino acid in a mimic peptide and renders the mimic peptide not immunogenic i.e. not recognized by the immune system.

In one embodiment, the genetic modification(s) that result(s) in a change of amino acid on the protein sequence are/is chosen so that a single genetic mutation cannot revert the modified amino acid back to original.

The invention encompasses methods for screening for genetic modifications in bacteria. In one embodiment, the method comprises:
administering, to a subject, a vector designed to genetically modify at least one base of a DNA sequence of interest in a gene or DNA sequence of a naturally occurring bacteria without introducing a double strand break in said DNA sequence,
subsequently collecting a bacterial sample from the subject, and
quantitating the level of bacteria containing a genetic modification in said at least one base of a DNA sequence of interest in said bacterial sample.

In one embodiment, the method comprises quantitating the level of bacteria not containing a genetic modification in at least one base of a DNA sequence of interest.

The invention encompasses methods for determining the efficiency of a vector at inducing genetic mutations in situ comprising:
administering, to a subject, a vector designed to genetically modify at least one base of a DNA sequence of interest in a gene or DNA sequence of a naturally occurring bacteria without introducing a double strand break in said DNA sequence,
subsequently collecting a bacterial sample from the subject,
quantitating the level of bacteria containing a genetic modification in said at least one base of a DNA sequence of interest and quantitating the level of bacteria not containing a genetic modification in said at least one base of a DNA sequence of interest in said bacterial sample.

The invention also encompasses a method for modifying a naturally occurring bacteria in situ in a subject, said method comprising:
  collecting a bacterial sample from the microbiome of the subject,
  contacting said bacterial sample with a vector designed to genetically modify at least one base of a DNA sequence of interest in a gene or DNA sequence of a naturally occurring bacteria without introducing a double strand break in said DNA sequence,
  quantitating the level of bacteria containing a genetic modification in said at least one base of a DNA sequence of interest and quantitating the level of bacteria not containing a genetic modification in said at least one base of a DNA sequence of interest in said bacterial sample, and determining thereby the efficiency of said vector at inducing genetic mutations in said subject, and
  administering, to said subject, said vector designed to genetically modify at least one base of a DNA sequence of interest in a gene or DNA sequence of a naturally occurring bacteria without introducing a double strand break in said DNA sequence, in particular when said determined efficiency is higher than or equal to a given value.

The invention encompasses methods for determining the effect of a genetic mutation on bacterial growth comprising:
  administering, to a subject, a vector designed to genetically modify at least one base of a DNA sequence of interest in a gene or DNA sequence of a naturally occurring bacteria, without introducing a double strand break in said DNA sequence,
  subsequently collecting at least two sequential bacterial samples from the subject,
  quantitating the level of bacteria containing a genetic modification in said at least one base of a DNA sequence of interest and quantitating the level of bacteria not containing a genetic modification in said at least one base of a DNA sequence of interest in said bacterial samples.

In one embodiment, said genetic modification is a genetic modification of the ClbP gene in pks+ *E. coli* that results in a single-amino acid mutation and the inactivation of the genotoxic activity of Colibactin toxin but maintains the antagonistic activity.

The invention encompasses a bacteriophage, bacterial virus particle or packaged phagemid for modifying in situ a naturally occurring bacteria, said bacteriophage, bacterial virus particle or packaged phagemid comprising a nucleic acid encoding a gene editing enzyme/system for transformation of a target bacteria in a mixed bacterial population wherein said gene editing enzyme/system modifies the genome of said target bacteria without introducing a double strand break in the DNA sequence, but does not lead to the death of the target bacteria. The invention encompasses the use of said bacteriophage, bacterial virus particle or packaged phagemid, wherein the gene editing enzyme/system targets a DNA sequence or gene within the target bacteria encoding a protein which is directly or indirectly responsible for a disease or disorder. The invention encompasses a bacteriophage, bacterial virus particle or packaged phagemid comprising a nucleic acid encoding a gene editing enzyme/system for transformation of a target bacteria in a mixed bacterial population wherein said gene editing enzyme/system modifies the DNA sequence or gene within said target bacteria encoding a protein which is directly or indirectly responsible for a disease or disorder without introducing a double strand break in the DNA sequence, for use for preventing and/or treating said disease or disorder.

Furthermore, a subject's microbiome can affect the metabolism of drug, food supplement, prebiotic or even cosmetic agent, or any compound administered or produced by the host or produced by other bacteria from the host, or affect the interaction of such compounds with the host or action of such compounds on the host. The invention thus also concerns a method to modify in situ interaction of a bacteria from a microbiome of a subject with a compound administered to or produced by said subject or produced by other bacteria from said subject, by modifying at least one bacterial DNA sequence involved in the interaction of said bacteria with said compound, said bacterial DNA sequence being expressed by a bacterial population of the host microbiome, said method comprising:
  contacting the bacterial population with a vector that generates a genetic modification in said at least one DNA sequence of the bacteria, involved in the interaction of said bacteria with said compound, in at least some of the bacteria of said population without introducing a double strand break in the DNA sequence;
  wherein the genetic modification of said at least one DNA sequence results in a modification of the interaction of the bacteria with said compound; and
  wherein the genetic modification does not lead to the direct death of the bacteria.

Said interaction of a bacteria with a compound administered to or produced by the subject or produced by other bacteria from said subject, encompasses (i) modification of said compound by said bacteria and/or (ii) competition between said compound and a molecule produced and/or secreted by said bacteria for a ligand from said subject and/or (iii) binding/adsorption of said compound by said bacteria.

In a particular embodiment, the invention concerns a method to modify the metabolism of a given drug in a host treated with said drug, by modifying at least one drug-targeting enzyme expressed by a bacterial population of the host microbiome, comprising:
  contacting the bacterial population with a vector that generates a genetic modification in a DNA sequence coding for a drug-targeting enzyme expressed or secreted by the bacteria in at least some of the bacteria of said population without introducing a double strand break in the DNA sequence,
  wherein the genetic modification of the DNA sequence coding for the drug-targeting enzyme results in a modification of the drug metabolism in the host;
  wherein genetic modification does not lead to the direct death of the bacteria.

Said modification of the metabolism of a given drug may be selected from the group consisting of a modification preventing-transformation of a given drug into a toxic compound for the host, a modification preventing hydrolysis of a given drug thus leading to a prolonged activity of said drug, an enzymatic modification of a given drug leading to an increased and/or prolonged activity of said drug, a transformation of said given drug into an active or more active compound, a modification preventing reactivation of detoxified compounds from a given drug.

The invention encompasses compositions and methods to ensure a robust alteration of all targeted bacteria within a microbiome population, thanks to the delivery of a nuclease programmed to discriminate between target bacteria that have been genetically modified in situ and target bacteria in which the modification has not occurred, leading to the specific killing of those in which the modification has not occurred. The present invention thus further concerns a method for ensuring a robust alteration of all targeted bacterial within a microbiome population, said method comprising contacting said microbiome population with a vector comprising a nucleic acid encoding a nuclease programmed to discriminate between targeted bacteria that have been genetically modified in situ and target bacteria in which the modification has not occurred, wherein said programmed nuclease enables the specific killing of targeted bacteria in which the modification has not occurred. In a particular embodiment, the delivery of such nuclease is either on the same DNA payload as the one containing the base-editing nuclease, or on a different payload. In other words, in a particular embodiment, the nucleic acid encoding said programmed nuclease is located on the same vector as the one comprising the nucleic acid encoding the base-editing nuclease or on a different vector. In a particular embodiment, the delivery of such nuclease is either simultaneous with or after the delivery of the payload containing the base-editing. In other words, in a particular embodiment, said vector comprising a nucleic acid encoding said programmed nuclease is administered either simultaneously or after the vector comprising the nucleic acid encoding the base-editing nuclease. If delivered simultaneously, the payload can be engineered to have a delayed targeting process for the programmed nuclease leading to DNA double strand break.

BRIEF DESCRIPTION OF DRAWINGS

In order to better understand the subject matter that is disclosed herein and to exemplify how it may be carried out in practice, embodiments will be described, by way of non-limiting example, with reference to the accompanying drawings. With specific reference to the drawings, it is stressed that the particulars shown are by way of example and for purposes of illustrative discussion of embodiments of the invention.

FIG. 4A) Adenine base editing (ABE=ABE8e) of mCherry. The experiment was performed in the presence (48 colonies analysed) or absence (2 colonies analysed) of a guideRNA targeting the active site of mCherry (tripeptide: M71, Y72, G73). FIG. 4B) Cytosine base editing (CBE=evoAPOBEC1-nCas9-UGI) of mCherry. The experiment was performed in the presence (48 colonies analysed) or absence (2 colonies analysed) of a guideRNA inserting a stop codon into mCherry. Fluorescence was measured by flow cytometry (arbitrary units a.u.) of individual colonies (1 dot represents a single colony after overnight incubation on agar plates).

FIG. 5A) Titers of lambda packaged phagemids comprising a base editor payload (ABE=ABE8e, CBE=evoAPOBEC1-nCas9-UGI). FIG. 5B) Multiplicity of infection (MOI)-dependent adenine base editing (ABE) targeting the active site of β-lactamase gene (K71E) on the genome. FIG. 5C) Multiplicity of infection (MOI)-dependent cytosine base editing (CBE) of β-lactamase. Editing of the active site of β-lactamase diminishes cell growth on carbenicillin plates.

TABLES

Figure 1:
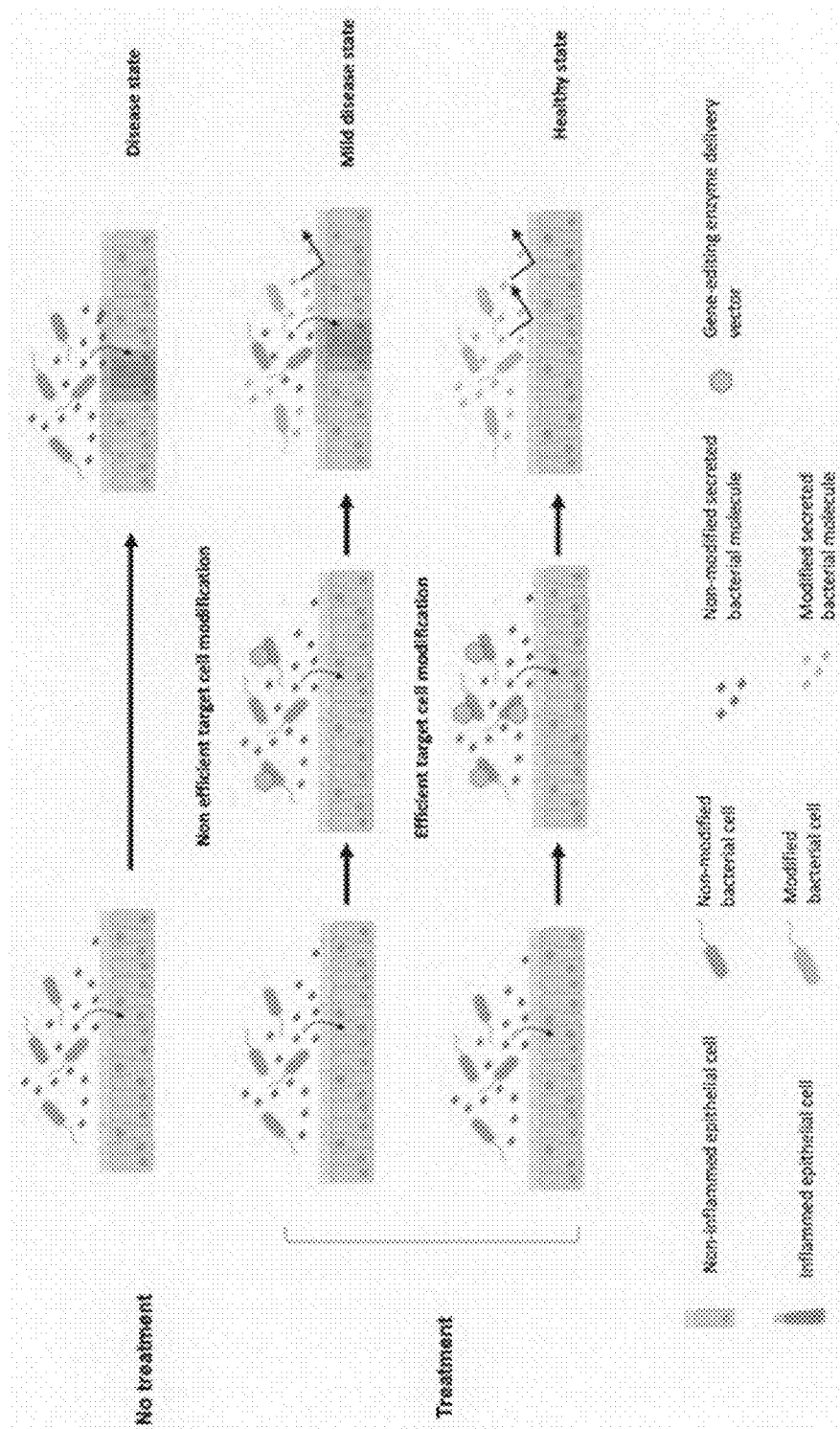
FIG. 1 depicts a method for modifying a naturally occurring bacteria in situ. Bacteria in absence of treatment produce molecules leading to pathogenicity such as inflammation. Upon treatment in the case of non-efficient target cell modification, only a fraction of the bacterial population is genetically modified to express a modified molecule that is non-pathogenic whereas non genetically modified bacteria are still producing the pathogenic variant. This heterogenous bacterial population and their associated molecules lead to mild disease state compared to the no treatment case. Finally, in case of an efficient target cell modification of all the population or a vast majority, the pathogenic variant of the molecule is not present anymore or in quantity low enough to have no pathogenicity and reach a healthy state.
Figure 2:
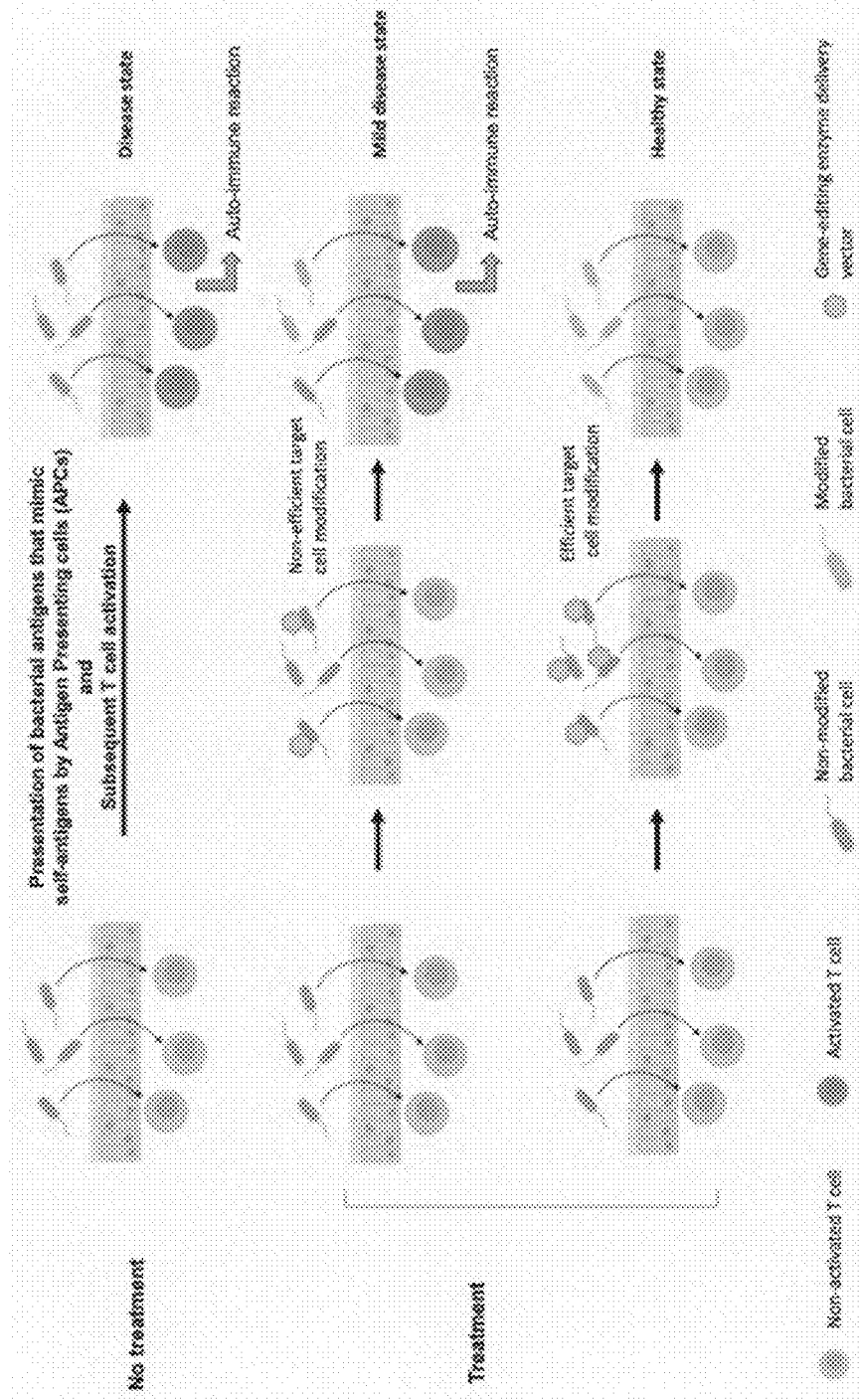
FIG. 2 depicts a method for modification of bacterial antigens in a naturally occurring bacteria in situ where the bacterial antigen mimics a human protein. The bacterial antigen is presented by an antigen presenting cell (APC) to a T cell leading to its activation and an immune response targeted towards on one side the bacterial antigen and on the other side the human protein or self-antigen thus leading to auto-immune reaction.
Figure 3:
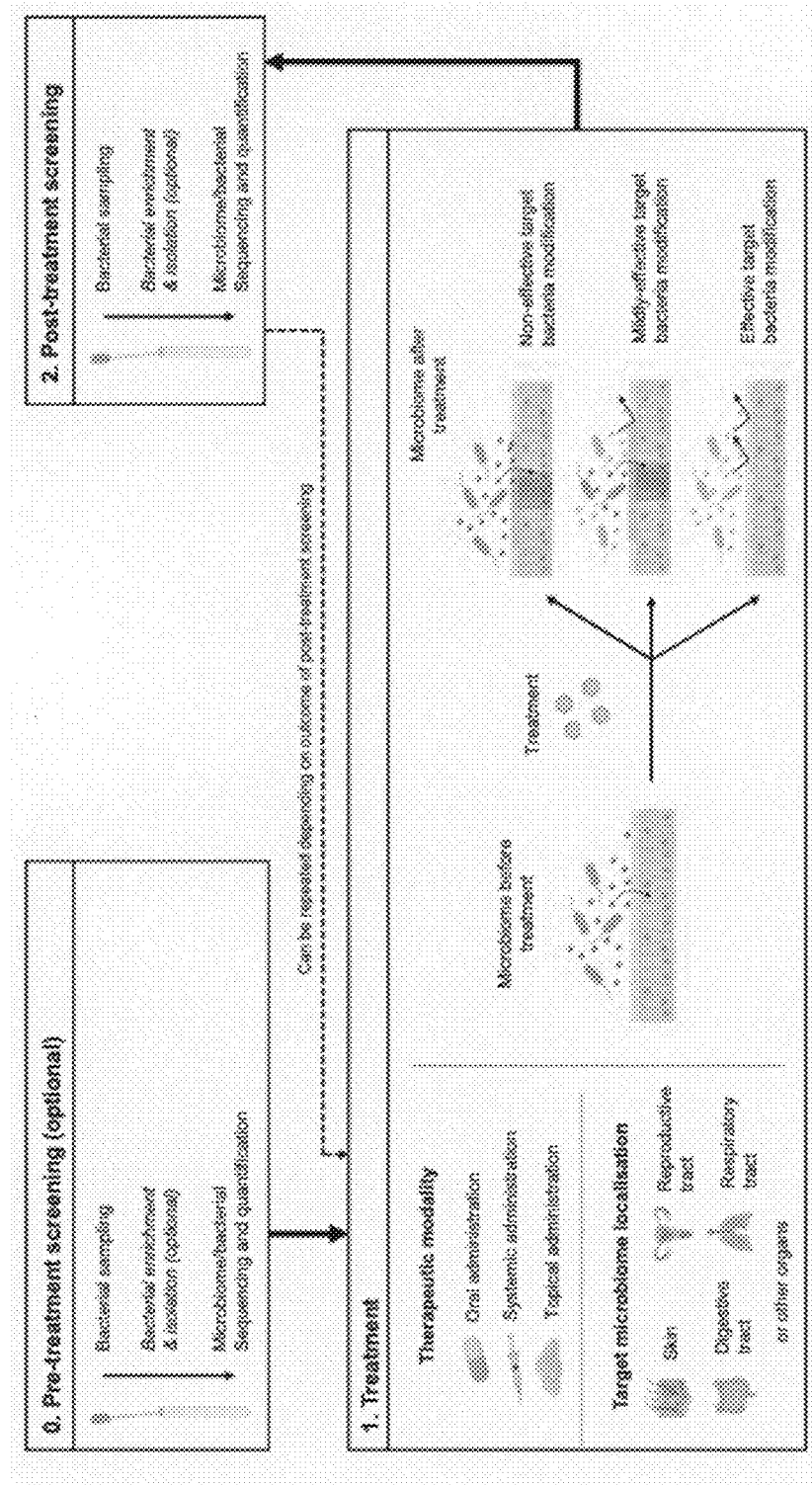
FIG. 3 depicts a screening method for the modification of a naturally occurring bacteria in situ. Before treatment the patient is optionally getting sampled to detect and quantify potential bacterial targets. Then the treatment is administered on different forms (oral, systemic, topical) depending on the target microbiome localization. After treatment the patient is getting sampled to detect and/or quantify bacterial targets and the genetic modifications induced by the treatment.

Table 1 presents gut bacterial species carrying candidate mimic peptide, amino acids sequence of related mimic peptide and Uniprot ID of bacterial and human protein containing each mimic peptide.

Table 2 presents nucleic acid sequences encoding drug-metabolizing gene products (identified by start nucleotide and end nucleotide in the listed contigs).

DETAILED DESCRIPTION OF INVENTION

The invention encompasses compositions, kits and methods, in particular non-therapeutic methods, for modifying a naturally occurring bacteria in situ. The invention further encompasses compositions, kits and methods, in particular non-therapeutic methods, for modifying a non-naturally occurring bacteria, such as one with an ex vivo genetic modification, in situ. The compositions, kits and methods of the invention genetically modify deleterious bacterial strains within the host microbiome to turn them into non-deleterious strains for the host without directly killing these strains.

The invention further encompasses modifications that improve or functionalize non deleterious bacteria. The invention further includes methods for screening for genetic modifications in the bacteria, for determining the efficiency of vectors at inducing these genetic mutations, and for determining the effects of these mutations on bacterial growth or on any bacterial function, for increasing the ratio of modified bacteria vs non-modified bacteria in situ, for increasing the chance that this approach leads to a positive outcome in a patient.

Preferably, the genetic modifications are modifications of a DNA sequence in the naturally occurring bacteria in situ without introducing a double strand break in the DNA sequence. Thus, the method includes generating no cleavages in the DNA sequence, generating a nick in one strand of the DNA sequence, or generating a staggered nicks in both strands of the DNA sequence, that do not lead to a double strand break in the DNA sequence.

Provided herein are compositions, kits and methods of treating, preventing or curing microbiome-associated diseases or disorders by modulating either the molecules expressed and/or secreted by bacterial populations of the microbiome or their expression/secretion levels, in a specific manner that will result in the modification of the interactions between part or all of these populations and the host in a way that decreases their deleterious potential on host health, and which will not result in the direct death of these populations, a direct significant inhibition of their growth or impairment of major bacterial function. The invention also concerns a vector encoding enzymes or systems for inducing genetic modifications in naturally occurring bacteria in situ for use for treating, preventing or curing a microbiome-associated disease or disorder by modulating either the molecules expressed and/or secreted by bacterial populations of the microbiome or their expression/secretion levels, in particular in a specific manner that will result in the modification of the interactions between part or all of these populations and the host in a way that decreases their deleterious potential on host health, and which will not result in the direct death of these populations, a direct significant inhibition of their growth or impairment of major bacterial function. The invention also concerns the use of a vector encoding enzymes or systems for inducing genetic modifications in naturally occurring bacteria in situ in the manufacture of a medicament intended to treat, prevent or cure a microbiome-associated disease or disorder by modulating either the molecules expressed and/or secreted by bacterial populations of the microbiome or their expression/secretion levels, in particular in a specific manner that will result in the modification of the interactions between part or all of these populations and the host in a way that decreases their deleterious potential on host health, and which will not result in the direct death of these populations, a direct significant inhibition of their growth or impairment of major bacterial function.

The invention encompasses the use of a vector that can transduce with high efficiency a nucleic acid, preferably a plasmid or a phagemid, into a bacterial population within the microbiome that allows the expression of an exogenous enzyme that will modify a DNA or gene sequence. The bacterial population can be a mixed bacterial population, comprising different strains of the same species; alternatively, the bacterial population can be a mixed bacterial population, comprising different strains of different species. In some embodiments, the DNA sequence or gene has a direct or indirect effect on the interactions of the bacteria with the host. Thus, the invention encompasses vectors for use in transducing with high efficiency a nucleic acid, preferably a plasmid or a phagemid, into a bacterial population.

In some embodiments, the DNA sequence or gene having a direct effect includes a DNA sequence or gene expressing a toxin that interacts with host cells, or a bacterial protein or peptide that includes a sequence of amino acids that mimic a sequence of amino acids present in the host proteins or peptides.

In some embodiments, the DNA sequence or gene having an indirect effect includes DNA sequences or genes that encode for an enzyme expressed, displayed on the membrane or secreted by the bacteria that is involved in the internal production or modification of a sugar, lipid, metabolite or protein that is present inside the bacteria, expressed or displayed on the membrane of the bacteria, secreted by the bacteria or imported by the bacteria.

Preferably, the precise modification of the DNA sequence or gene sequence is performed so that it minimizes any effect on the ability of the bacteria to grow and interact with other microorganisms in its biological environment, but modifies its interaction with the host or its growth or resistance potential during a treatment.

Methods of Genetic Modification

The invention encompasses methods of modifying a naturally occurring bacteria in situ. Preferably, the genetic modification does not lead to the death of bacteria. More preferably, the genetic modification results in less than a 5%, 10%, 20%, or 50% growth disadvantage of the modified bacteria in vivo due to the genetic modification. Even more preferably, the genetic modification does not result in any growth disadvantage of the modified bacteria in vivo due to the modification. Preferably, the genetic modification is a modification of a DNA sequence in the naturally occurring bacteria in situ without introducing a double strand break in the DNA sequence, In a preferred embodiment, the bacteria are contacted in situ with a vector that can transfer with high efficiency a nucleic acid into the bacteria to express an exogenous enzyme in the bacteria that results in a genetic modification. In a preferred embodiment, the exogenous enzyme can result in this genetic modification through base editing strategies where dCas9 (dead-Cas9) or nCas9 (nickase Cas9) is fused to cytosine or adenosine deaminase domain and directed to the target sequence to make the desired modification.

In a preferred embodiment, the exogenous enzyme can result in this genetic modification through prime editing strategies where dCas9 (dead-Cas9) or nCas9 (nickase Cas9) is fused to reverse transcriptase domain and directed to the target sequence to make the desired modification with the help of a pegRNA (prime editing guide RNA).

Nevertheless, the invention also contemplates introducing a double strand break or a single strand break i.e. a nick in the bacterial DNA at a specific sequence, for example with a CRISPR/Cas system, together with non-homologous end joining (NHEJ) or homologous recombination (HR) to generate the desired genetic modification. Preferably, the double strand break or the single strand break is generated in the presence of an editing template comprising homologous regions with DNA regions located around the specific sequence located in the bacterial DNA.

The genetic modification can be a point mutation(s), a deletion(s), insertion(s) or any combination thereof.

In some embodiments, the genetic modification can inactivate, reduce, increase or induce the expression of a DNA sequence or gene. The genetic modification can be in the translated or untranslated regions of a gene. The genetic modification can be in the promoter region of a gene or within any other region involved in gene regulation.

In some embodiments, the DNA sequence or gene inactivation can be a point mutation(s) inside the coding sequence (starts with start codon, ends with stop codon). More precisely, the DNA sequence or gene inactivation can be performed by a point mutation(s) converting one or several codons to stop codon (TAA, TAG, TGA). Alternatively, the DNA sequence or gene inactivation can be performed by a point mutation(s) converting the start codon (ATG, GTG, TTG) or any in-frame start codon in 5, 10, 20, 50, 100 bp of the predicted start codon into a non-start codon or a stop codon. Alternatively, the DNA sequence or gene inactivation can be performed by point mutation(s) introducing rare codons inside the codon sequence. Alternatively, the DNA sequence or gene inactivation can be performed by point mutation(s) introducing non-synonymous amino acid change(s) in a catalytic site making the protein inactive for the function associated to this catalytic site. Alternatively, the DNA sequence or gene inactivation can be performed by point mutation(s) introducing non-synonymous amino acid change(s) in a site involving binding other molecules where the interaction is necessary for the protein activity.

In some embodiments, the DNA sequence or gene inactivation can be a point mutation(s) outside the coding sequence. Point mutation(s) can be in the promoter region of a gene (e.g. −35 bp region, −10 bp region, transcription start site (TSS)), in the Ribosome Binding Site (RBS) of the gene or within any other region involved in regulation (e.g. transcription factor binding site, operator binding site, riboswitch . . . ).

In some embodiments, the genetic modification can lead to DNA sequence or gene activation.

In some embodiments, the genetic modification can be a point mutation(s) that revert a previously characterized mutation that inactivate, decrease or increase the activity of a gene or pathway.

In some embodiments, the genetic modification can be a point mutation(s) leading to modulation of DNA sequence or gene expression and regulation. Point mutation(s) can be in promoter region of a gene (e.g. −35 bp region, −10 bp region, transcription start site (TSS)), in the Ribosome Binding Site (RBS) of the gene, within any other region involved in regulation (e.g., transcription factor binding site, operator binding site, RNAse recognition site, riboswitch, methylation sit, etc.) or in any other DNA sequence or gene regulating the DNA sequence or gene of interest such as a repressor, an antisense RNA, an activator.

In some embodiments, the genetic modification can be point mutation(s) leading to modulation of post translational modification(s) (e.g., phosphorylation, glycosylation, acetylation, pupylation, etc.). More particularly the modification can be a point mutation in the post translational modification site. Alternatively, the genetic modification can disrupt the DNA sequence or gene responsible for post-translational modification(s).

In another embodiment, the genetic modification is a point mutation(s) that revert a mutation that leads to an increase of pathogenicity.

In a particular embodiment, the genetic modification does not integrate a phage genome or exogenous DNA into the host bacterial chromosome or endogenous plasmid(s). In a particular embodiment, the genetic modification does not result in expression of an exogenous protein from an integrated exogenous DNA in the host bacterial chromosome or endogenous plasmid(s). In a more particular embodiment, the genetic modification does not involve either NHEJ or HR endogenous repair mechanism of the host bacteria.

In some embodiments, the genetic modification results in the change in at least 1, 2, 3, 4, 5, 6, 7, 8, 9, 10, 11, 12, 13, 14, 15, 20, 25, 30, 35, 40, 45, 50, 100, 200, 500, etc. amino acids to a different amino acid.

The invention encompasses methods, in particular non-therapeutic methods, of modulating host-microbiome interaction by genetically modifying naturally occurring bacteria in situ. Preferably, the naturally occurring bacteria is involved in microbiome associated disorder or disease. In preferred embodiments, the method comprises genetically modifying a DNA sequence responsible for the microbiome associated disorder or disease in the naturally occurring bacteria in situ, wherein the genetic modification reduces the effects of the microbiome associated disorder or disease, and wherein the genetic modification does not lead to the death of bacteria. The invention further encompasses a vector encoding enzymes or systems for inducing genetic modifications in naturally occurring bacteria in situ for use in a method for reducing the effects of a microbiome associated disorder or disease, wherein said vector genetically modifies a DNA sequence, in the naturally occurring bacterial in situ, responsible for said microbiome associated disorder or disease, and wherein the genetic modification does not lead to the death of bacteria. Preferably, the bacteria with the genetic modification does not have a reduced in vivo growth rate as compared to the same bacteria without the genetic modification.

In some embodiments, the genetic modification occurs within a pathogenic bacterial DNA sequence or gene encoding a virulence factor to block pathogenesis, which de-facto might reduce the fitness of the bacteria, since virulence factor often confer a fitness advantage of the pathogenic bacteria over its bacterial competitors. This might for example lead to a lower growth-rate.

In other embodiments, the genetic modification occurs within commensal bacteria or opportunistic pathogens, and the modification has a small or no impact on the growth rate of this bacteria as a commensal bacteria.

The invention encompasses methods to prevent or intervene in the course of an auto-immune disease or reaction in a predisposed host by modifying the immunogenic profile of a bacterial population of the human or animal microbiome. In preferred embodiments, the method comprises contacting the bacterial population with a vector that generates a genetic modification in a DNA sequence coding for an immunogenic component expressed or secreted by the bacteria in at least some of the bacteria of said population, wherein the genetic modification of the DNA sequence coding for the immunogenic component results in loss of the immunogenic effect of said immunogenic component, and wherein the genetic modification does not lead to the direct death of the bacteria. The invention further encompasses a vector encoding enzymes or systems for inducing genetic modifications for use in a method to prevent or intervene in the course of an auto-immune disease or reaction in a predisposed host by modifying the immunogenic profile of a bacterial population of the human or animal microbiome. In preferred embodiments, said vector generates a genetic modification in a DNA sequence coding for an immunogenic component expressed or secreted by the bacteria in at least some of the bacteria of said population, wherein the genetic modification of the DNA sequence coding for the immunogenic component results in loss of the immunogenic effect of said immunogenic component, and wherein the genetic modification does not lead to the direct death of the bacteria.

Preferably, the bacteria with the genetic modification does not have a reduced in vivo growth rate as compared to the same bacteria without the genetic modification.

In some embodiments, the genetic modification results in a change of amino acid in a mimic peptide and renders the mimic peptide not immunogenic or not recognized by the immune system. In some embodiments, the genetic modification results in a change of sugar profile on the bacterial membrane. In some embodiments, the genetic modification results in a change of amino acid in a protein sequence that results in a change of sugar profile on the bacterial membrane. In some embodiments, the genetic modification results in a change of lipid profile on the bacterial membrane. In some embodiments, the genetic modification results in a change of amino acid in a protein sequence that results in a change of lipid profile on the bacterial membrane. In some embodiments, the genetic modification results in a change at the protein sequence level leading to an inactive catalytic site. In some embodiments, the genetic modification renders a binding site with a human cell receptor non-functional. In some embodiments, the genetic modification renders the bacteria more sensitive to detection by human immune cells.

Modification of a Bacterial Toxin Gene Sequence

In some embodiment, the genetic modification is made in a toxin gene sequence so that the toxin is still produced, expressed and or secreted but renders its toxigenic effect null, resulting in the modification of one or multiple amino acids of the catalytic site of the enzyme so that it cannot exert its toxigenic effect on the host cells.

Alternatively, the genetic modification is made in a toxin gene sequence so that the toxin gene sequence is not expressed or disrupted, resulting in the inactivation of the toxin.

The targeted bacterial toxin can be an exotoxin or endotoxin. Exotoxins are generated and actively secreted; endotoxins remain part of the bacteria. The response to a bacterial toxin can involve severe inflammation and can lead to sepsis.

Preferred toxins include Colibactin of *E. coli*, Toxin A and other enzymes (e.g., hemolysin, leukotoxin, exfoliative toxin, enterotoxin, and toxic-shock syndrome toxin-1 (TSST-1)) from *Staphylococcus aureus* as described in Tam and Torres, Microbiol Spectr. 2019 March; 7(2), which is hereby incorporated by reference, and fragilysin (Bft) from Enterotoxigenic (ETBF) strains of *Bacteroides fragilis*, Botulinum neurotoxin, Tetanus toxin, Diphteria toxin, Anthrax toxin, Alpha toxin, Pertussis toxin, Shiga toxin, Heat-stable enterotoxin (*E. coli* ST), or any toxin described in Henkel et al., (Toxins from Bacteria in EXS. 2010; 100: 1-29, which is hereby incorporated by reference).

By "colibactin" is meant herein a secondary metabolite synthetized by the clbA-S genes present in the 54-kb pathogenicity pks island, a genetic island encoding a non-ribosomal peptide synthetase-polyketide synthase (NRPS-PKS) assembly line in Enterobacteriaceae. Colibactin is typically produced as a prodrug moiety that is exported in the periplasm by the efflux pump ClbM and then hydrolyzed by the periplasmic membrane-bound ClbP protein with a peptidase activity, which releases the active colibactin.

In preferred embodiments, the genetic modification is a point mutation(s) leading to toxin gene disruption such as described previously.

Preferably, the bacteria with the genetic modification do not have a reduced in vivo growth rate as compared to the same bacteria without the genetic modification.

Preferably, the genetic modification(s) are done so that a single genetic mutation cannot revert the activity of the toxin. This can be achieved by changing the original amino acid for another amino acid that cannot be reverted to original by a single substitution.

In one embodiment, the method comprises making a genetic modification in the ClbP gene in pks+ *E. coli* that result in a single-amino acid mutation and the inactivation of the genotoxic activity of Colibactin toxin, but maintains the antagonistic activity. In a particular embodiment, the genetic modification is in the ClbP gene in pks+ *E. coli* and results in a single-amino acid mutation and the inactivation of the genotoxic activity of Colibactin toxin, while maintaining its antagonistic activity.

As used herein, the ClbP gene is typically of sequence SEQ ID NO: 2316 and typically encodes a protein of sequence SEQ ID NO: 2317.

Preferably, the genetic modification is at codons of the ClbP gene encoding amino acids S95 or K98 of the protein encoded by the ClbP gene, in particular at codons of the ClbP gene encoding amino acids S95 or K98 of SEQ ID NO: 2317. Most preferably, the genetic modification is a mutation S95A, S95R or K98T in the ClbP gene.

In some embodiments, the genetic modification is made in a *Shigella* toxin gene such as, without limitation, stx1 and stx2. In some embodiments, the genetic modification is made in a *E. coli* toxin gene such as, without limitation, Stx1 (VT1), Stx2 (VT2), Stx2a (VT2a), Stx2b (VT2b), Stx2c (VT2c), Stx2d (VT2d), Stx2e (VT2e) and Stx2f (VT2f), Stx2h (VT2h), stx2k.

Modification of Other Bacterial Virulence Gene Sequence

In one embodiment, the modification can be made in and inactivate a virulence factor. A virulence factor can be any substance produced by a pathogen that alters host-pathogen interaction by increasing the degree of damage done to the host. Virulence factors are used by pathogens in many ways, including, for example, in cell adhesion or colonization of a niche in the host, to evade the host's immune response, to facilitate entry to and egress from host cells, to obtain nutrition from the host, or to inhibit other physiological processes in the host. Virulence factors can include enzymes, endotoxins, adhesion factors, motility factors, factors involved in complement evasion, scavenging factors and factors that promote biofilm formation.

In some embodiments, the genetic modification is made in a *E. coli* virulence factor gene such as, without limitation, EHEC-HlyA, fimA, fimF, fimH, neuC, kpsE, sfa, foc, iroN, aer, iha, papC, papGI, papGII, papGIII, hlyC, cnf1, hra, sat, ireA, usp ompT, ibeA, malX, fyuA, irp2, traT, afaD, ipaH, eltB, estA, bfpA, eaeA, espA, aaiC, aatA, TEM, CTX, SHV, csgA, csgB, csgC, csgD, csgE, csgF, csgG, csgH, or genes within T1SS, T2SS, T3SS, T4SS, T5SS, T6SS (secretion systems).

In one embodiment, the method comprises making a genetic modification in the FimH gene in *E. coli* that results in reverting the following mutations: N70S and S78N associated with AEIC strains[3]. In a particular embodiment, the genetic modification is made in the FimH gene in *E. coli*.

In the context of the invention, the FimH gene typically encodes a Type 1 fimbrin D-mannose specific adhesin. The FimH gene is typically of sequence SEQ ID NO: 2319 and typically encodes a protein of sequence SEQ ID NO: 2318.

In one embodiment, the genetic modification is made in the FimH gene in *E. coli* and preferably results in reverting the mutations N70S and S78N associated with AEIC strains.

In one embodiment, the method comprises making a genetic modification in the blc gene in *E. coli* that result in reverting the mutation G84E (G251A at the nucleotide level) potentially associated with gut inflammation[4].

In the context of the invention, the blc gene typically encodes an Outer membrane lipoprotein Blc. The bcl gene is typically of sequence SEQ ID NO: 2321 and typically encodes a protein of sequence SEQ ID NO: 2320.

In one embodiment, the genetic modification is made in the blc gene in *E. coli* and preferably results in reverting the mutation G84E (G251A at the nucleotide level) potentially associated with gut inflammation.

In some embodiments, the genetic modification is made in a *Yersinia pestis* virulence factor gene such as, without limitation, yscF (plasmid-borne (pCDI) T3SS external needle subunit).

In some embodiments, the genetic modification is made in a *Yersinia pestis* virulence factor gene such as, without limitation, yscF (plasmid-borne (pCDI) T3SS external needle subunit).

In some embodiments, the genetic modification is made in a *Francisella tularensis* virulence factor gene such as, without limitation, fslA.

In some embodiments, the genetic modification is made in a *Bacillus anthracis* virulence factor gene such as, without limitation, pag (Anthrax toxin, cell-binding protective antigen).

In some embodiments, the genetic modification is made in a *Vibrio cholera* virulence factor gene such as, without limitation, ctxA and ctxB (cholera toxin), tcpA (toxin co-regulated pilus), and toxT (master virulence regulator).

In some embodiments, the genetic modification is made in a *Pseudomonas aeruginosa* virulence factor genes such as, without limitation, pyoverdine (e.g., sigma factor pvdS, biosynthetic genes pvdL, pvdI, pvdJ, pvdH, pvdA, pvdF, pvdQ, pvdN, pvdM, pvdO, pvdP, transporter genes pvdE, pvdR, pvdT, opmQ), siderophore pyochelin (e.g., pchD, pchC, pchB, pchA, pchE, pchF and pchG, and toxins (e.g., exoU, exoS and exoT).

In some embodiments, the genetic modification is made in a *Klebsiella pneumoniae* virulence factor gene such as, without limitation, fimA (adherence, type I fimbriae major subunit), and cps (capsular polysaccharide).

In some embodiments, the genetic modification is made in an *Acinetobacter baumannii* virulence factor gene such as, without limitation, ptk (capsule polymerization) and epsA (assembly).

In some embodiments, the genetic modification is made in a *Salmonella enterica Typhi* virulence factor gene such as, without limitation, MIA (invasion, SPI-1 regulator), ssrB (SPI-2 regulator), and those associated with bile tolerance, including efflux pump genes acrA, acrB and tolC.

In some embodiments, the genetic modification is made in a *Fusobacterium nucleatum* virulence factor gene such as, without limitation, FadA and TIGIT.

In some embodiments, the genetic modification is made in a *Bacteroides fragilis* virulence factor gene such as, without limitation, bft.

In some embodiments, the genetic modification is made in a *Cutibacterium acnes* porphyrins gene, a CAMP-factor (CAMP1, CAMP2, CAMP3, CAMP4), Hyaluronate lyase (HYL-IB/II, HYL-IA), Lipases (GehA, GehB), Haemolysins, Sialidases, Endoglycoceramidases, Endo-ß-N-acetylglucosaminidase, Dermatan sulphate adhesin (DsA1, DsA2), Proline-Threonine Repeats (PTRs) or in any virulence factors included on the acne associated genomic loci 1, 2, 3 (plasmid), 4 such as a tight adhesion locus (tad), Streptolysin S-associated genes (sag), nonribosomal peptide synthetases (NRPS) as described in Tomida et al[5], which is hereby incorporated by reference.

Modification of a Mimic Peptide Gene Sequence

In some embodiments, the genetic modification is made in a mimic peptide gene sequence so that the homology with the human peptide sequence is reduced, and therefore results in the mimic peptide being not recognized anymore by the host immune system. Mimic peptides of particular interest are bacterial mimic peptides that are associated with autoimmune diseases, for example those mentioned in Negi et al.[6], which are hereby incorporated by reference. Of particular interest are the gene sequences encoding any of the mimic peptides in S1 Table of Negi et al.

In a particular embodiment, the mimic peptide is one of the candidate mimic peptides disclosed in Table 1 below. In a particular embodiment, said mimic peptide is selected from the group consisting of the peptides of sequence SEQ ID NO: 19 to 2313.

In preferred embodiments, the mimic peptide is from Proteobacteria or Firmicutes. Of particular interest are the gene sequences encoding 24 gut bacterial peptides identified by Negi et al. with homology to four human peptides from Low molecular weight phosphotyrosine protein phosphatase, Aldehyde dehydrogenase family 3 member B1, Maleylacetoacetate isomerase and Uracil-DNA glycosylase. These gene sequences can be modified to reduce the homology with the human sequences and prevent cross-reactivity of those recognized by the host immune system with the human counterpart.

In a preferred embodiment, the genetic modification is in the *Bacteroides faecis* or *Bacteroides thetaiotaomicron* beta-galactosidase gene. Preferably, the *Bacteroides faecis* or *Bacteroides thetaiotaomicron* beta-galactosidase protein with the genetic modification shows lower homology with human MYH6 cardiac peptide as compared to the *Bacteroides faecis* or *Bacteroides thetaiotaomicron* beta-galactosidase protein without the genetic modification[2]. Preferably the genetic modification is performed in the peptides fragment recognized as epitope by the human immune system leading to a weaker or absence of epitope recognition by the human immune system[2].

In a preferred embodiment, the genetic modification is in human commensal bacteria encoding a Ro60 ortholog gene. Preferably, the Ro60 protein resulting from the genetic modification shows lower homology with human Ro60 peptide as compared to the original protein. Preferably the genetic modification is performed in the DNA sequence corresponding to peptides fragment recognized as epitope by the human immune system leading to a weaker or absence of epitope recognition by the human immune system. Preferably the human bacterial commensal targeted for genetic modification are: *Propionibacterium propionicum, Corynebacterium amycolatum, Actinomyces massiliensis, Bacteroides thetaiotaomicron*. Even more preferably the human bacterial commensal targeted for genetic modification is *Propionibacterium propionicum*[7].

In a preferred embodiment, the genetic modification is in human commensal bacterial DNA sequence encoding a peptide that mimic insulin B 9-25, a self-epitope involved in type 1 diabetes[8]. The genetic mutation reduces homology to the insulin B9-25 epitope SHLVEALYLVCGERGFF (SEQ ID NO: 9). In a preferred embodiment, the target bacteria belong to the Firmicutes phylum. In a preferred embodiment, the target gene in the target bacteria is part of the transketolase N superfamily[8].

In a preferred embodiment, the genetic modification is in *Roseburia intestinalis* encoding a peptide that mimic the epitope of the autoantigen $β_2$-glycoprotein I ($β_2$GPI), a self-epitope involved in antiphospholipid syndrome (APS). The genetic mutation is reducing homology to the T cell ($β_2$GPI) epitope KVSFFCKNKEKKCSY (SEQ ID NO: 10) and/or B cell epitope VSRGGMRKFIC (SEQ ID NO: 11)[28].

Modification of an Antibiotic-Resistance Gene Sequence

In some embodiments, the modification is made in an antibiotic-resistance gene sequence, carried on the chromosome or on a plasmid, to render the bacteria sensitive to an antibiotic without exerting a direct selective pressure on the bacteria in the absence of the related antibiotic.

In some embodiment, the genetic modification is made to revert mutations in endogenous genes, some of which are essential to the bacteria, that confer resistance to antibiotics such as: RpoB rifampicin resistant mutant, 23S rRNA erythromycin resistant mutant, GyrA (fluoro) quinolone resistant mutant, GyrB (fluoro) quinolone resistant mutant, RpsL streptomycin resistant mutant, DHFR trimethoprim resistant mutant, fusA fusidic acid resistant mutant, fmt actinonin resistant mutant, gidB streptomycin resistant mutant, ompR multidrug resistant mutant, marR multidrug resistant mutant, Ion multidrug resistant mutant, mgrB colistin resistant mutant, pmrA colistin resistant mutant, acrR multidrug resistant mutant, cysB amdinocillin resistant mutant, 16S rRNA methyltransferase.

In some embodiments, the antibiotic resistance gene can be, without limitation, GyrB, ParE, ParY, AAC(1), AAC(2'), AAC(3), AAC(6'), ANT(2"), ANT(3"), ANT(4'), ANT(6), ANT(9), APH(2"), APH(3"), APH(3'), APH(4), APH(6), APH(7"), APH(9), ArmA, RmtA, RmtB, RmtC, Sgm, AER, BLA1, CTX-M, KPC, SHV, TEM, BlaB, CcrA, IMP, NDM, VIM, ACT, AmpC, CMY, LAT, PDC, OXA β-lactamase, mecA, Omp36, OmpF, PIB, bla (blaI, blaR1) and mec (mecI, mecR1) operons, Chloramphenicol acetyltransferase (CAT), Chloramphenicol phosphotransferase, Ethambutol-resistant arabinosyltransferase (EmbB), MupA, MupB, Integral membrane protein MprF, Cfr 23S rRNA methyltransferase, Rifampin ADP-ribosyltransferase (Arr), Rifampin glycosyltransferase, Rifampin monooxygenase, Rifampin phosphotransferase, DnaA, RbpA, Rifampin-resistant beta-subunit of RNA polymerase (RpoB), Erm 23S rRNA methyltransferases, Lsa, MsrA, Vga, VgaB, Streptogramin Vgb lyase, Vat acetyltransferase, Fluoroquinolone acetyltransferase, Fluoroquinolone-resistant DNA topoisomerases, Fluoroquinolone-resistant GyrA, GyrB, ParC, Quinolone resistance protein (Qnr), FomA, FomB, FosC, FosA, FosB, FosX, VanA, VanB, VanD, VanR, VanS, Lincosamide nucleotidyltransferase (Lin), EreA, EreB, GimA, Mgt, Ole, Macrolide phosphotransferases (MPH), MefA, MefE, Mel, Streptothricin acetyltransferase (sat), Sul1, Sul2, Sul3, sulfonamide-resistant FoIP, Tetracycline inactivation enzyme TetX, TetA, TetB, TetC, Tet30, Tet31, TetM, TetO, TetQ, Tet32, Tet36, MacAB-TolC, MsbA, MsrA,VgaB, EmrD, EmrAB-TolC, NorB, GepA, MepA, AdeABC, AcrD, MexAB-OprM, mtrCDE, EmrE, adeR, acrR, baeSR, mexR, phoPQ, mtrR, or any antibiotic resistance gene described in the Comprehensive Antibiotic Resistance Database at card. mcmaster.ca/.

In preferred embodiments, the antibiotic is selected from the group consisting of penicillins such as penicillin G, penicillin K, penicillin N, penicillin 0, penicillin V, methicillin, benzylpenicillin, nafcillin, oxacillin, cloxacillin, dicloxacillin, ampicillin, amoxicillin, pivampicillin, hetacillin, bacampicillin, metampicillin, talampicillin, epicillin, carbenicillin, ticarcillin, temocillin, mezlocillin, and piperacillin; cephalosporins such as cefacetrile, cefadroxil, cephalexin, cefaloglycin, cefalonium, cephaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefmetazole, cefotetan, cefoxitin, loracarbef, cefbuperazone, cefminox, cefotetan, cefoxitin, cefotiam, cefcapene, cefdaloxime, cefdinir, cefditoren, cefetamet, cefixime, cefmenoxime, cefodizime, cefotaxime, cefovecin, cefpimizole, cefpodoxime, cefteram, ceftamere, cefti buten, ceftiofur, ceftiolene, ceftizoxime, ceftriaxone, cefoperazone, ceftazidime, latamoxef, cefclidine, cefepime, cefluprenam, cefoselis, cefozopran, cefpirome, cefquinome, flomoxef, ceftobiprole, ceftaroline, ceftolozane, cefaloram, cefaparole, cefcanel, cefedrolor, cefempidone, cefetrizole, cefivitril, cefmatilen, cefmepidium, cefoxazole, cefrotil, cefsumide, ceftioxide, cefuracetime, and nitrocefin; polymyxins such as polysporin, neosporin, polymyxin B, and polymyxin E, rifampicins such as rifampicin, rifapentine, and rifaximin; Fidaxomicin; quinolones such as cinoxacin, nalidixic acid, oxolinic acid, piromidic acid, pipemidic acid, rosoxacin, ciprofloxacin, enoxacin, fleroxacin, lomefloxacin, nadifloxacin, norfloxacin, ofloxacin, pefloxacin, rufloxacin, balofloxacin, grepafloxacin, levofloxacin, pazufloxacin, temafloxacin, tosufloxacin, clinafloxacin, gatifloxacin, gemifloxacin, moxifloxacin, sitafloxacin, trovafloxacin, prulifloxacin, delafloxacin, nemonoxacin, and zabofloxacin; sulfonamides such as sulfafurazole, sulfacetamide, sulfadiazine, sulfadimidine, sulfafurazole, sulfisomidine, sulfadoxine, sulfamethoxazole, sulfamoxole, sulfanitran, sulfadimethoxine, sulfametho-xypyridazine, sulfametoxydiazine, sulfadoxine, sulfametopyrazine, and terephtyl; macrolides such as azithromycin, clarithromycin, erythromycin, fidaxomicin, telithromycin, carbomycin A, josamycin, kitasamycin, midecamycin, oleandomycin, solithromycin, spiramycin, troleandomycin, tylosin, and roxithromycin; ketolides such as telithromycin, and cethromycin; fluoroketolides such as solithromycin; lincosamides such as lincomycin, clindamycin, and pirlimycin; tetracyclines such as demeclocycline, doxycycline, minocycline, oxytetracycline, and tetracycline; aminoglycosides such as amikacin, dibekacin, gentamicin, kanamycin, neomycin, netilmicin, sisomicin, tobramycin, paromomycin, and streptomycin; ansamycins such as geldanamycin, herbimycin, and rifaximin; carbacephems such as loracarbef; carbapenems such as ertapenem, doripenem, imipenem (or cilastatin), and meropenem; glycopeptides such as teicoplanin, vancomycin, telavancin, dalbavancin, and oritavancin; lincosamides such as clindamycin and lincomycin; lipopeptides such as daptomycin; monobactams such as aztreonam; nitrofurans such as furazolidone, and nitrofurantoin; oxazolidinones such as linezolid, posizolid, radezolid, and torezolid; teixobactin, clofazimine, dapsone, capreomycin, cycloserine, ethambutol, ethionamide, isoniazid, pyrazinamide, rifabutin, arsphenamine,chloramphenicol, fosfomycin, fusidic acid, metronidazole, mupirocin, platensimycin, quinupristin (or dalfopristin), thiamphenicol, tigecycline, tinidazole, trimethoprim, alatrofloxacin, fidaxomicin, nalidixic acid, rifampin, derivatives and combination thereof.

Modification to a Conserved Sequence

In some embodiments, the modification of the amino-acid sequence is made so that the edited sequence corresponds to an amino-acid sequence encoding for the same or a related protein/function/activity coming from one or multiple different strains from the same species, or from a related species, or from the same genus, or from any other bacteria from the microbiome. The edited sequence can correspond to a paralog, ortholog or analog of the original sequence.

This modification can reduce the potential selective pressure applied to the edited bacteria by ensuring a relatively similar function while not having the same exact amino-acid sequence.

Modification of DNA Sequences Involved in Interactions Between Bacteria and Compounds Administered to or Produced by the Subject or Produced by Other Bacteria The invention also concerns a method to modify in situ interaction of a bacteria from a microbiome of a subject with a compound administered to or produced by said subject or produced by other bacteria from said subject, by modifying at least one bacterial DNA sequence involved in the interaction of said bacteria with said compound, said bacterial DNA sequence being expressed by a bacterial population of the host microbiome, said method comprising:

contacting the bacterial population with a vector that generates a genetic modification in said at least one DNA sequence of the bacteria, involved in the interaction of said bacteria with said compound, in at least some of the bacteria of said population without introducing a double strand break in the DNA sequence;

wherein the genetic modification of said at least one DNA sequence results in a modification of the interaction of the bacteria with said compound; and wherein the genetic modification does not lead to the direct death of the bacteria.

By "interaction of a bacteria with a compound administered to or produced by a subject or produced by other bacteria from said subject" is meant any type of interaction, inducing or not a modification in the structure and/or activity of said compound, and involving any component of the bacteria (including enzymes, receptors, channels, sugars, lipids, etc. . . . ) in any location of said bacteria (e.g. at the membrane, capsule, in the cytoplasm, etc). Said interaction of a bacteria with a compound administered to or produced by the subject or produced by other bacteria encompasses (i) modification of said compound by said bacteria and/or (ii) competition between said compound and a molecule produced and/or secreted by said bacteria for a ligand from said subject and/or (iii) binding/adsorption of said compound by said bacteria.

By "ligand" is meant herein a substance binding, in particular specifically binding, to a compound of interest. In the context of the invention, ligands from the subject encompasses receptors, enzymes, immune molecules, etc. . . . , able to bind said compound of interest.

Said compound administered to said subject can be any type of compound such as a drug, a prebiotic, a cosmetic agent, a food supplement, etc. . . . .

Said compound produced by the subject may be, without limitation, bile acids (such as taurocholic acid, glycocholic acid, taurochenodeoxycholic acid, glycochenodeoxycholic acid, deoxycholic acid, lithocholic acid, and derivatives of cholic, chenodeoxycholic and deoxycholic acids), hormones (such as Adrenaline (or epinephrine), Melatonin, Noradrenaline (or norepinephrine), Triiodothyronine, Thyroxine, Dopamine, Prostaglandins, Leukotrienes, Prostacyclin, Thromboxane, Amylin, Anti-Müllerian hormone (or Müllerian-inhibiting factor/hormone), Adiponectin, Adrenocorticotropic hormone (or corticotropin), Angiotensinogen, Angiotensin, Antidiuretic hormone (or vasopressin, arginine vasopressin), Atrial natriuretic peptide (or atriopeptin), Brain natriuretic peptide, Calcitonin, Cholecystokinin, Corticotropin-releasing hormone, Cortistatin, Enkephalin, Endothelin, Erythropoietin, Follicle-stimulating hormone, Galanin, Gastric inhibitory polypeptide, Gastrin, Ghrelin, Glucagon, Glucagon-like peptide-1, Gonadotropin-releasing hormone, Growth hormone-releasing hormone, Hepcidin, Human chorionic gonadotropin, Human placental lactogen, Growth hormone, Inhibin Peptide, Insulin, Insulin-like growth factor (or somatomedin), Leptin, Lipotropin, Luteinizing hormone, Melanocyte stimulating hormone, Motilin, Orexin, Osteocalcin, Oxytocin (or pitocin), Pancreatic polypeptide, Parathyroid hormone, Pituitary adenylate cyclase-activating peptide, Prolactin (or leuteotropic hormone), Prolactin-releasing hormone, Relaxin, Renin, Secretin, Somatostatin (or growth hormone-inhibiting hormone or growth hormone release-inhibiting hormone or somatotropin release-inhibiting factor or somatotropin release-inhibiting hormone), Thrombopoietin, Thyroid-stimulating hormone (or thyrotropin), Thyrotropin-releasing hormone, Vasoactive intestinal peptide, Guanylin, Uroguanylin, Testosterone, Dehydroepiandrosterone, Androstenedione, Di hydrotestosterone, Aldosterone, Estradiol, Estrone, Estriol, Cortisol, Progesterone, Calcitriol or Calcidiol) or perspiration compounds.

In a particular embodiment, the invention concerns a method to modify the metabolism of a given drug in a host treated with said drug, by modifying at least one drug-targeting enzyme expressed by a bacterial population of the host microbiome, comprising:

contacting the bacterial population with a vector that generates a genetic modification in a DNA sequence coding for a drug-metabolizing gene product, in particular a drug-targeting enzyme, expressed or secreted by the bacteria in at least some of the bacteria of said population without introducing a double strand break in the DNA sequence, wherein the genetic modification of the gene coding for the drug-metabolizing gene protein, in particular the drug-targeting enzyme, results in a modification of the drug metabolism in the host;

wherein genetic modification does not lead to the direct death of the bacteria.

By "drug metabolism" is meant herein the biotransformation of pharmaceutical substances in the body. In the context of the invention, drug metabolism encompasses both the pathway leading to the elimination of the drug and the more general evolution of the drug activity in the subject one administered to said subject.

Said modification of the metabolism of a given drug may be selected from the group consisting of preventing transformation of the given drug into a toxic compound for the host, preventing hydrolysis of the given drug thus leading to a prolonged activity of said drug, an enzymatic modification of the given drug leading to an increased and/or prolonged activity of said drug, a transformation of said given drug into an active or more active compound, a modification preventing reactivation of detoxified compounds from a given drug.

Said given drug may be selected from the group consisting of Nicardipine.HCl, Risperidone, Tolcapone, Azathioprine, Entacapone, Exemestane, Nimodipine, Capsaicin, Dexamethasone, Ethacrynic Acid, Rifampin (Rifampicin), Sulindac, Vorinostat, Dolasetron, Mycophenolate Mofetil, Zidovudine (3'-Azido-3'-Deoxythymidine), Allopurinol, Betamethasone, Bisacodyl, Estradiol, Famciclovir, Flutamide, Hydrocortisone, Hydrocortisone Acetate, Methylprednisolone, Metronidazole, Nabumetone, Pantoprazole, Prednisolone, Progesterone, Prednisone, Spironolactone, Sulfasalazine, Tinidazole, Fluoxetine.HCl, Misoprostol, Megestrol Acetate, Capecitabine, Chenodiol (Chenodeoxycholic Acid), Clofazimine, Clonazepam, Cortisone Acetate, Dantrolene.Na, Duloxetine, Fludrocortisone Acetate, Iloperidone, Lorazepam, Nilutamide, Nitisinone, Nitrofurantoin, Oxazepam, Paliperidone, Prasugrel, Probenecid, Rifabutin, Sulfamethoxazole, Ursodiol, Omeprazole, Tenatoprazole, Artemisinin, Danazol, Olmesartan medoxomil, Phenazopyridine, Nitrendipine, Racecadrotil, Fenofibrate, Fluphenazine, Telmisartan, Benzbromarone, Oxethazaine, Mefloquine, Quinacrine, Pimozide, Loxapine succinate, Cyclobenzaprine, Ethopropazine, Promethazine, Clemizole and Pyrimethamine.

Said given drug may further be selected from the group consisting of abacavir sulfate, acebutolol, acecainide, alfuzosin, almotriptan, alprenolol, amantadine, aminoglutethimide, amisulpride, anagrelide, anastrozole, antazoline phosphate, apomorphine, artemisinin, atenolol, atorvastatin calcium, azatadine maleate, bambuterol, Benazepril, benzbromarone, benzthiazide, betamethasone acetate, betamethasone valerate, betaxalol, bezafibrate, bicalutamide, biperiden, bisacodyl, bisoprolol fumarate, bromocriptine mesylate, budesonide, bupropion, buramate, buspirone, camylofine dihydrochloride, capecitabine, carbetapentane citrate, carbinoxamine maleate, carisoprodol, Carvedilol, celecoxib, cetirizine, chlormezanone, cimetidine, citalopram hydrobromide, clemastine fumarate, clemizole, clenbuterol, clidinium bromide, clonidine, clopidogrel sulfate, Clozapine, colchicine, cyclobenzaprine, cyclophosphamide, cyproterone acetate, dabigatran etexilate mesylate, danazol, darifenacin hydrobromide, dasatinib, deflazacort, desvenlafaxine succinate, dexamethasone, dextromethorphan hydrobromide, diacetamate, Dicyclomine, diflorasone diacetate, digitoxin, digoxin, diltiazem, diperodon, diphenylpyraline, Dipyridamole, disopyramide phosphate, domperidone, doxazosin mesylate, doxepin, doxylamine succinate, drospirenone, duloxetine, eletriptan hydrobromide, enalapril maleate, Entacapone, ergonovine maleate, ergotamine tartrate, eszopiclone, ethopropazine, ethoxzolamide, ethynodiol diacetate, etodolac, ezetimibe, famciclovir, famprofazone, febuxostat, fenofibrate, fenspiride, fexofenadine, finasteride, fluconazole, fluoxetine, fluphenazine, fluvoxamine maleate, galantamine, gliclazide, glipizide, griseofulvin, guanfacine, haloperidol, hyoscyamine, idebenone, imatinib, indapamide, indomethacin, Irbesartan, irsogladine maleate, isradipine, itraconazole, ketorolac tromethamine, ketotifen fumarate, labetalol, lamotrigine, letrozole, levamisole, levonorgestrel, linagliptin, lofexidine, Loperamide, losartan, lovastatin, loxapine succinate, mebendazole, mebhydrolin naphthalenesulfonate, mefloquine, megestrol acetate, melphalan, memantine, metaxalone, Methocarbamol, methoxsalen, methsuximide, methylphenidate, methysergide maleate, meticrane, metitepine maleate, metoclopramide, metolazone, metoprolol tartrate, mevastatin, mianserin, mifepristone, milnacipran, mycophenolate mofetil, nadolol, nafronyl oxalate, naftopidil, naloxone, naproxen(+), nateglinide, nefazodone, nefopam, neostigmine bromide, nevirapine, nicergoline, nitrendipine, nizatidine, norethindrone acetate, Norgestimate, noscapine, olanzapine, olmesartan medoxomil, omeprazole, orphenadrine citrate, oxaprozin, oxcarbazepine, oxethazaine, oxybutynin chloride, Paclitaxel, paliperidone, pantoprazole, papaverine, paroxetine, penbutolol sulfate, pentoxifylline, pergolide mesylate, pericyazine, perindopril erbumine, phenacetin, Phenazopyridine, phenytoin sodium, pidotimod, pimozide, pitavastatin calcium, Pranoprofen, prazosin, prednisone, pridinol methanesulfonate, primaquine phosphate, Procarbazine, promethazine, pyrimethamine, quetiapine, quinacrine, quinapril, quinine sulfate, racecadotril, ramelteon, ramipril, ranitidine, ranolazine, rebamipide, repaglinide, Reserpine, riluzole, rimantadine, risperidone, ritonavir, rivastigmine tartrate, rizatriptan benzoate, ropinirole, rosiglitazone maleate, rosuvastatin calcium, roxatidine acetate, sertraline, sildenafil citrate, solifenacin succinate, sotalol, spiperone, sulfasalazine, sulfinpyrazone, sulindac, sulpiride, sumatriptan succinate, tacrine, tacrolimus, tadalafil, tamsulosin hydrchloride, tegaserod maleate, telmisartan, tenatoprazole, tenoxicam, terazosin, terbinafine, thiabendazole, thiothixene, tiapride, timolol maleate, tinidazole, Tolazamide, topotecan, trandolapril, tranilast, trazodone, trihexyphenidyl, trimebutine maleate, trimetazidine dihydrochloride, trimethobenzamide, trimipramine maleate, Triprolidine, tropisetron, trospium chloride, valsartan, venlafaxine, verapamil, vilazodone, Vinpocetine, voriconazole, warfarin, zaleplon, zidovudine [azt], ziprasidone mesylate and zolpidem.

In a particular embodiment, in particular when said given drug is selected from the list of drugs above, said drug-metabolizing gene product is selected from the group consisting of the gene products encoded by the nucleic acid sequences listed in Table 2 below, or is a gene product the amino acid sequence of which is at least 90% identical, in particular at least 91%, 92%, 93%, 94%, 95%, 96%, 97%, 98% or 99% identical to one of the gene products encoded by the nucleic acid sequences listed in Table 2 below.

In a particular embodiment, in particular when said given drug is selected from the list of drugs above, said drug-metabolizing gene product is expressed or secreted by a bacteria selected from the group consisting of the bacteria recited in Table 2 below.

In a particular embodiment, said drug-targeting enzyme is selected from enzymes having oxidation, deamination, isomerization, esterification, condensation, reduction, hydrolysis and/or rearrangement activities. In a particular embodiment, said drug-targeting enzyme is selected from β-glucuronidases, nitroreductases and sulfoxide reductases.

In a particular embodiment, said given drug is dantrolene, clonazepam, and/or nicardipine, and said drug-targeting enzyme is an enzyme having nitro-reduction activity.

In an alternative embodiment, said given drug is risperidone, and said drug-targeting enzyme is an enzyme having hydrolysis activity, in particular an enzyme hydrolysing the isoxazole moiety of risperidone.

In an alternative embodiment, said given drug is sulfasalazine, and said drug-targeting enzyme is an enzyme having azoreduction activity.

In an alternative embodiment, said given drug is digoxin, and said drug-targeting enzyme is cytochrome glycoside reductase, said bacteria expressing said drug-targeting enzyme being preferably *Eggerthella lenta*.

In an alternative embodiment, said given drug is levodopa (L-DOPA), and said drug-targeting enzyme is tyrosine decarboxylase, preferably expressed by *Enterococcus faecalis*, *Enterococcus faecium* and/or *Lactobacillus brevis* and/or dopamine dehydrolase, preferably expressed by *Eggerthella lenta*. In a more particular embodiment, said genetic modification in the DNA sequence encoding said tyrosine decarboxylase induces inactivation of said enzyme, enabling preventing decarboxylation, and thereby inactivation, of L-DOPA by said enzyme, in subjects suffering from Parkinson's disease and treated with levodopa.

In another embodiment, said given drug is levodopa (L-DOPA), and said drug-targeting enzyme is DHPAA synthase, preferably expressed by *Clostridium sporogenes*. In a more particular embodiment, said genetic modification in the DNA sequence encoding DHPAA synthase induces inactivation of said enzyme, enabling preventing deamination of L-DOPA, and thereby transformation of L-DOPA into 3,4-dihydroxyphenylacetaldehyde (DHPAA), and preventing and/or reducing constipation in subjects suffering from Parkinson's disease and treated with levodopa.

In an alternative embodiment, said given drug is gemcitabine, and said drug-targeting enzyme is cytidine deaminase, said bacteria expressing said drug-targeting enzyme being preferably *Escherichia coli* and/or Gammaproteobacteria.

In an alternative embodiment, said given drug is prontosil, and said drug-targeting enzyme is an enzyme converting prontosil into p-aminobenzenesulfonamide by azo-reduction.

In an alternative embodiment, said given drug is selected from sulfasalazine, ipsalazide and balsalazide, and said drug-targeting enzyme is an enzyme converting said drug into 5-aminosalicylic acid.

In an alternative embodiment, said given drug is a non-steroidal anti-inflammatory drug, and said drug-targeting enzyme is a β-glucuronidase.

In a particular embodiment, said compound is L-DOPA, and said modification of the interaction is a modification in the adsorption of L-DOPA by *Helicobacter pylori*, typically by modifying bacterial adhesins from *H. pylori* involved in said adsorption.

In a particular embodiment, said compound is acetaminophen and said modification of the interaction is a modification in the competition between acetaminophen and p-cresol produced by *C. difficile*, typically by modifying DNA sequences involved in the production and/or secretion of p-cresol by *C. difficile*.

The present invention thus also concerns a method of treatment of a subject in need thereof, comprising
  administering a drug to said subject, and
  before, simultaneously with, or after said administration of said drug, administering to said subject a vector encoding enzymes or systems for inducing genetic modifications in a DNA sequence coding for a drug-targeting enzyme expressed or secreted by the bacteria in at least some of the bacteria of said population without introducing a double strand break in the DNA sequence,
  wherein the genetic modification of the DNA sequence coding for the drug-targeting enzyme results in a modification of the drug metabolism in the subject;
  wherein genetic modification does not lead to the direct death of the bacteria.

The present invention thus also concerns a pharmaceutical combination comprising a drug and a vector encoding enzymes or systems for inducing genetic modifications in a DNA sequence coding for a drug-targeting enzyme expressed or secreted by the bacteria in at least some of the bacteria of said population without introducing a double strand break in the DNA sequence, for simultaneous, sequential or separate use in the treatment of a subject.

The invention also concerns a method for increasing the efficacy of a drug treatment in a subject in need thereof, comprising:
  administering a drug to said subject, and
  before, simultaneously with, or after said administration of said drug, administering to said subject a vector encoding enzymes or systems for inducing genetic modifications in a DNA sequence coding for a drug-targeting enzyme expressed or secreted by the bacteria in at least some of the bacteria of said population without introducing a double strand break in the DNA sequence,
  wherein the genetic modification of the DNa sequence coding for the drug-targeting enzyme results in a modification of the drug metabolism in the subject;
  wherein genetic modification does not lead to the direct death of the bacteria.

Lack of Inhibition of Bacterial Growth

Bacteria with the genetic modification can be assessed for any inhibition of bacterial growth by comparison with the same bacteria without the genetic modification either in vitro or in vivo. This is preferably performed by assessing the percentage of bacteria with and without the genetic modification at at least two timepoints and determining that the bacteria with the genetic modification do not have a reduced percentage at the later time point.

Comparison in vitro can be performed by growing the bacteria in solid or liquid culture and determining the percentages of each type of bacteria over time. The percentages can be determined by routine diagnostic procedures including ELISA, PCR, High Resolution Melting, and nucleic acid sequencing.

Comparison in vivo can be performed by collecting samples (e.g., stool or swab) over time and determining the percentages of each type of bacteria over time. The percentages can be determined by routine diagnostic procedures employing immunodetection (e.g. ELISA), nucleic acid amplification (e.g., PCR), High Resolution Melting, and nucleic acid sequencing.

Preferred percentages of bacteria with the genetic modification are at least 70%, 80%, 90%, 95%, 97%, 98%, 99%, 99.9%, 99.99%, and 100%.

Enzymes and Systems for Inducing Modifications

In some embodiments, the genetic modification is made with one or more of the following enzymes and systems.

Cytosine base editors (CBE) and Adenosine base editors (ABE), as described in Rees et al.[9] which is hereby incorporated by reference.

So far there are seven types of DNA base editors described:

Cytosine Base Editor (CBE) that convert C:G into T:A[32]
Adenine Base Editor (ABE) that convert A:T into G:C[33]
Cytosine Guanine Base Editor (CGBE) that convert C:G into G:C[29,30]
Cytosine Adenine Base Editor (CABE) that convert C:G into A:T[31]
Adenine Cytosine Base Editor (ACBE) that convert A:T into C:G[34]
Adenine Thymine Base Editor (ATBE) that convert A:T into T:A[35]
Thymine Adenine Base Editor (TABE) that convert T:A into A:T[36-38]

Base editors differ in the base modification enzymes. CBE rely on ssDNA cytidine deaminase among which: APOBEC1, rAPOBEC1, APOBEC1 mutant or evolved version (evoAPOBEC1), and APOBEC homologs (APOBEC3A (eA3A), Anc689), Cytidine deaminase 1 (CDA1), evoCDA1, FERNY, evoFERNY.

ABE rely on deoxyadenosine deaminase activity of a tandem fusion TadA-TadA* where TadA* is an evolved version of TadA, an E. coli tRNA adenosine deaminase enzyme, able to convert adenosine into Inosine on ssDNA. TadA* include TadA-8a-e and TadA-7.10.

Except from base modification enzyme there has been also modifications implemented to base editor to increase editing efficacy, precision and modularity:

the addition of one or two uracil DNA glycosylase inhibitor domain (UGI) to prevent base excision repair mechanism to revert base edition
the addition of Mu-GAM that decrease insertion-deletion rate by inhibiting Non-homologous end joining mechanism in the cell (NHEJ)
the use of nickase active Cas9 (nCas9 D10A) that, by creating nicks on the non-edited strand favors its repair and consequently the fixation of the edited base.
the use of diverse Cas proteins from for example different organisms, mutants with different PAM motifs or different fidelity or different family (e.g. Cas12a).

Non-limiting examples of DNA-based editor proteins include BE1, BE2, BE3, BE4, BE4-GAM, HF-BE3, Sniper-BE3, Target-AID, Target-AID-NG, ABE, EE-BE3, YE1-BE3, YE2-BE3, YEE-BE3, BE-PLUS, SaBE3, SaBE4, SaBE4-GAM, Sa(KKH)-BE3, VQR-BE3, VRER-BE3, EQR-BE3, xBE3, Cas12a-BE, Ea3A-BE3, A3A-BE3, TAM, CRISPR-X, ABE7.9, ABE7.10, ABE7.10*, xABE, ABESa, VQR-ABE, VRER-ABE, Sa(KKH)-ABE, ABE8e, SpRY-ABE, SpRY-CBE, SpG-CBE4, SpG-ABE, SpRY-CBE4, SpCas9-NG-ABE, SpCas9-NG-CBE4, enAsBE1.1, enAsBE1.2, enAsBE1.3, enAsBE1.4, AsBE1.1, AsBE1.4, CRISPR-Abest, CRISPR-Cbest, eA3A-BE3, AncBE4.

Cytosine Guanine Base Editors (CGBE) consist of a nickase CRISPR fused to:
a. A cytosine deaminase (rAPOBEC) and base excision repair proteins (e.g. rXRCC1).[29,41]
b. A rat APOBEC1 variant (R33A) protein and an E. coli-derived uracil DNA N-glycosylase (eUNG).[30]

Cytosine Adenine Base Editors (CABE) consist of a Cas9 nickase, a cytidine deaminase (e.g. AID), and a uracil-DNA glycosylase (Ung).[31]

ACBE include a nucleic acid programmable DNA-binding protein and an adenine oxidase.34

ATBE consist of a Cas9 nickase and one or more adenosine deaminase or an oxidase domain.[35]

TABE consist of a Cas9 nickase and an adenosine methyltransferase, a thymine alkyltransferase, or an adenosine deaminase domain.[36-38]

Base editor molecules can also consist of two or more of the above listed editor enzymes fused to a Cas protein (e.g. combination of an ABE and CBE). These biomolecules are named dual base editors and enable the editing of two different bases.[39,40]

In a particular embodiment, the genetic modification is made with a Cytosine base editor (CBE) and/or an Adenosine base editor (ABE) as defined above.

Prime editors (PE), as described in Anzalone et al.[10] which is hereby incorporated by reference, consist of a nCas9 fused to a reverse transcriptase used in combination with a prime editing RNA (pegRNA; a guide RNA that includes a template region for reverse transcription).

Prime Editing allows introduction of insertions, deletions (indels), and 12 base-to-base conversions. Prime editing relies on the ability of a reverse transcriptase (RT), fused to a Cas nickase variant, to convert RNA sequence brought by a prime editing guide RNA (pegRNA) into DNA at the nick site generated by the Cas protein. The DNA flap generated from this process is then included or not in the targeted DNA sequence.

Prime editing systems include:
a Cas nickase variant such as Cas9-H840A fused to a reverse transcriptase domain such as M-MLV RT or its mutant version (M-MLV RT(D200N), M-MLV RT(D200N/L603W), M-MLV RT(D200N/L603W/T330P/T306K/W313F)
a prime editing guide RNA (pegRNA)

To favor editing, the prime editing system can include the expression of an additional sgRNA targeting the Cas nickase activity towards the non-edited DNA strand ideally only after the resolution of the edited strand flap by designing the sgRNA to anneal with the edited strand but not with the original strand.

Non-limiting examples of prime editing systems include PE1, PE1-M1, PE1-M2, PE1-M3, PE1-M6, PE1-M15, PE1-M3inv, PE2, PE3, PE3b.

Cas9 Retron preciSe Parallel Editing via homologY ('CRISPEY'), a retron RNA fused to the sgRNA and expressed together with Cas9 and the retron proteins including at least the reverse transcriptase[11].

The SCRIBE strategy: a retron system expressed in combination with a recombinase promoting the recombination of single stranded DNA, also known as single stranded annealing proteins (SSAPs)[12]. Such recombinases include but are not limited to phage recombinases such as lambda red, recET, Sak, Sak4, and newly described SSAPs described in Wannier et al[13] which is hereby incorporated by reference.

The targetron system based on group II introns described in Karberg et al.[14], which is hereby incorporated by reference, and which has been adapted to many bacterial species.

Other retron based gene targeting approaches are described in Simon et al.[15] which is hereby incorporated by reference.

CRISPR-Cas. The CRISPR system contains two distinct elements, i.e. i) an endonuclease, in this case the CRISPR associated nuclease (Cas or "CRISPR associated protein") and ii) a guide RNA. Depending on the type of CRISPR system, the guide RNA may be in the form of a chimeric RNA which consists of the combination of a CRISPR (crRNA) bacterial RNA and a tracrRNA (trans-activating RNA CRISPR)[16]. The guide RNA combines the targeting specificity of the crRNA corresponding to the "spacing sequences" that serve as guides to the Cas proteins, and the conformational properties of the tracrRNA in a single transcript. When the guide RNA and the Cas protein are expressed simultaneously in the cell, the target genomic sequence can be permanently interrupted (and causing disappearance of the targeted and surrounding sequences and/or cell death, depending on the location) or modified. The modification may be guided by a repair matrix.

The CRISPR system includes two main classes depending on the nuclease mechanism of action:
  Class 1 is made of multi-subunit effector complexes and includes type I, Ill and IV
  Class 2 is made of single-unit effector modules, like Cas9 nuclease, and includes type II (II-A, II-B, II-C, II-C variant), V (V-A, V-B, V-C, V-D, V-E, V-U1, V-U2, V-U3, V-U4, V-U5) and VI (VI-A, VI-B1, VI-B2, VI-C, VI-D)

The sequence of interest according to the present invention preferably comprises a nucleic acid sequence encoding Cas protein. A variety of CRISPR enzymes are available for use as a sequence of interest on the vector according to the present invention. In some embodiments, the CRISPR enzyme is a Type II CRISPR enzyme, a Type II-A or Type II-B CRISPR enzyme. In another embodiment, the CRISPR enzyme is a Type I CRISPR enzyme or a Type III CRISPR enzyme. In some embodiments, the CRISPR enzyme catalyzes DNA modification. In some other embodiments, the CRISPR enzyme catalyzes RNA modification. For instance, Cas13-deaminase fusions have been used for RNA base editing thus modifying RNA[17]. In one embodiment, the CRISPR enzymes may be coupled to a guide RNA or single guide RNA (sgRNA). In certain embodiments, the guide RNA or sgRNA targets a DNA sequence or gene selected from the group consisting of an antibiotic resistance gene, virulence protein or factor gene, toxin protein or factor gene, a bacterial receptor gene, a membrane protein gene, a structural protein gene, a secreted protein gene, a gene expressing resistance to a drug in general and a gene causing a deleterious effect to the host. Preferably, the CRISPR enzyme does not make a double strand break. In some embodiments, the CRISPR enzyme makes a single strand break or nicks. In some embodiments, the CRISPR enzyme does not make any break in the DNA or RNA. In one embodiment, a Cas13-deaminase fusion is used to base edit an RNA.

The sequence of interest may comprise a nucleic acid sequence encoding a guide RNA or sgRNA to guide the Cas protein endogenous to the targeted bacteria, alone or in combination with a Cas protein and/or a guide RNA encoded by the vector.

Non-limiting examples of Cas proteins as part of a multi-subunit effector or as a single-unit effector include Cas1, Cas1B, Cas2, Cas3, Cas4, Cas5, Cas6, Cas7, Cas8, Cas9 (also known as Csn1 and Csx12), Cas10, Cas11 (SS), Cas12a (Cpf1), Cas12b (C2c1), Cas12c (C2c3), Cas12d (CasY), Cas12e (CasX), C2c4, C2c8, C2c5, C2c10, C2c9, Cas13a (C2c2), Cas13b (C2c6), Cas13c (C2c7), Cas13d, Csa5, Csc1, Csc2, Cse1, Cse2, Csy1, Csy2, Csy3, Csf1, Csf2, Csf3, Csf4, Csm1, Csm2, Csm3, Csm4, Csm5, Csm6, Cmr1, Cmr3, Cmr4, Cmr5, Cmr6, Csn2, Csb1, Csb2, Csb3, Csx17, Csx14, Csx10, Csx16, CsaX, Csx13, Csx1, Csx15, SdCpf1, CmtCpf1, TsCpf1, CmaCpf1, PcCpf1, ErCpf1, FbCpf1, UbcCpf1, AsCpf1, LbCpf1, homologues thereof, orthologues thereof, variants thereof, or modified versions thereof. In some embodiments, the CRISPR enzyme cleaves both strands of the target nucleic acid at the Protospacer Adjacent Motif (PAM) site.

In various embodiments, the nucleic acid of interest encodes fusion proteins comprising a Cas9 (e.g., a Cas9 nickase) domain and a deaminase domain. In some embodiments, the fusion protein comprises Cas9 and a cytosine deaminase enzyme, such as APOBEC enzymes, or adenosine deaminase enzymes, such as ADAT enzymes, for example as disclosed in U.S. Patent Publ. 2015/0166980, which is hereby incorporated by reference. In one embodiment, the deaminase is an ACF1/ASE deaminase.

In various embodiments, the APOBEC deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase. In various embodiments, the fusion protein comprises a Cas9 domain, a cytosine deaminase domain, and a uracil glycosylase inhibitor (UGI) domain.

In one embodiment, the deaminase is an adenosine deaminase that deaminate adenosine in DNA, for example as disclosed in U.S. Pat. No. 10,113,163, which is hereby incorporated by reference. In some embodiments, the fusion proteins further comprise an inhibitor of base repair, such as, a nuclease dead inosine specific nuclease (dISN), for example as disclosed in U.S. Pat. No. 10,113,163. In various embodiments, the nucleic acid of interest encodes fusion proteins comprising a catalytically impaired Cas9 endonuclease fused to an engineered reverse transcriptase, programmed with a prime editing guide RNA (pegRNA) that both specifies the target site and encodes the desired edit, for example as described in Anzalone et al.[10], which is hereby incorporated by reference.

In a particular embodiment, the CRISPR enzyme is any Cas9 protein, for instance any naturally-occurring bacterial Cas9 as well as any variants, homologs or orthologs thereof.

By "Cas9" is meant a protein Cas9 (also called Csn1 or Csx12) or a functional protein, peptide or polypeptide fragment thereof, i.e. capable of interacting with the guide RNA(s) and of exerting the enzymatic activity (nuclease) which allows it to perform the double-strand cleavage of the DNA of the target genome. "Cas9" can thus denote a modified protein, for example truncated to remove domains of the protein that are not essential for the predefined functions of the protein, in particular the domains that are not necessary for interaction with the gRNA(s). Preferably, the Cas9 is a dCas9 (dead-Cas9) or nCas9 (nickase Cas9) lacking double strand DNA cleavage activity.

The sequence encoding Cas9 (the entire protein or a fragment thereof) as used in the context of the invention can be obtained from any known Cas9 protein[18-20]. Examples of Cas9 proteins useful in the present invention include, but are not limited to, Cas9 proteins of *Streptococcus pyogenes*

(SpCas9), *Streptococcus thermophiles* (St1Cas9, St3Cas9), *Streptococcus mutans, Staphylococcus aureus* (SaCas9), *Campylobacter jejuni* (CjCas9), *Francisella novicida* (FnCas9) and *Neisseria meningitides* (NmCas9).

The sequence encoding Cpf1 (Cas12a) (the entire protein or a fragment thereof) as used in the context of the invention can be obtained from any known Cpf1 (Cas12a) protein[18,19]. Examples of Cpf1(Cas12a) proteins useful in the present invention include, but are not limited to, Cpf1(Cas12a) proteins of *Acidaminococcus* sp, *Lachnospiraceae bacteriu* and *Francisella novicida*.

The sequence encoding Cas13a (the entire protein or a fragment thereof) as used in the context of the invention can be obtained from any known Cas13a (C2c2) protein[21]. Examples of Cas13a (C2c2) proteins useful in the present invention include, but are not limited to, Cas13a (C2c2) proteins of *Leptotrichia wadei* (LwaCas13a).

The sequence encoding Cas13d (the entire protein or a fragment thereof) as used in the context of the invention can be obtained from any known Cas13d protein (Yan et al. (2018) *Mol Cell* 70(2):327-339).Examples of Cas13d proteins useful in the present invention include, but are not limited to, Cas13d proteins of *Eubacterium siraeum* and *Ruminococcus* sp.

In some embodiments, other programmable nucleases can be used. These include an engineered TALEN (Transcription Activator-Like Effector Nuclease) and variants, engineered zinc finger nuclease (ZFN) variants, natural, evolved or engineered meganuclease or recombinase variants, and any combination or hybrids of programmable nucleases. Thus, the programmable nucleases provided herein may be used to selectively modify DNA encoding a DNA sequence or gene of interest such as, for example, a toxin gene, a virulence factor gene, an antibiotic resistance gene, a remodeling gene or a modulatory gene (cf. WO2014124226 and US2015/0064138).

In some embodiments, the genetic modification is made at the RNA level. RNA base editing is based on the same principle as DNA base editing: an enzyme catalyzing the conversion of a RNA base into another must be brought close to the target base to perform its conversion locally. In one embodiment, the enzyme used for RNA editing is an adenosine deaminase from ADAR family that converts Adenosine into Inosine in dsRNA structure. Several seminal studies used this specificity for dsRNA and fused the ADAR deaminase domain ($ADAR_{DD}$) to an antisense oligo in order to program local RNA base editing. More recently the ability of some CRISPR-Cas systems to bind RNA molecules was repurposed into RNA editing. Using catalytically dead Cas13b enzyme (dPspCas13b) fused to a hyperactive mutant of ADAR2 deaminase domain ($ADAR2_{DD}$-E488Q for REPAIRv1 and $ADAR2_{DD}$-E488Q-T375G for REPAIRv2) Cox et al improved specificity and efficiency compare to previous RNA editing strategies.

Non-limiting examples of RNA based editor proteins include REPAIRv1, REPAIRv2.

Vectors for Inducing Modifications

In various embodiments, one or more of the following vectors can be used to introduce the exogenous enzyme that results in a genetic modification:
- Engineered phages
- Engineered bacteria
- Plasmid (e.g., a conjugative plasmid capable of transfer into a host cell), phage, phagemid or prophage.
- Each vector may be as described above, eg, a phage capable of infecting a host cell or conjugative plasmid capable of introduction into a host cell, which can be introduced either by a phage particle (engineered or wild-type phage) via injection or by a donor bacteria via conjugation. In an example, the vectors are in combination with an antibiotic agent (e.g., a beta-lactam antibiotic) and/or with any other agent.

A bacteriophage for modifying a naturally occurring bacteria in situ comprising a nucleic acid encoding a gene editing enzyme/system for transformation of a target bacteria in a mixed bacterial population wherein said gene editing enzyme/system modifies the genome of said target bacteria, but does not lead to the death of the target bacteria.

The invention encompasses the use of these vectors wherein the gene editing enzyme/system targets a DNA sequence or gene within the target bacteria encoding a protein which is directly or indirectly responsible for a disease or disorder.

In a particular embodiment, said vector does not replicate in the targeted bacteria.

Origin of Replication

In preferred embodiments the DNA in the vector will comprise an origin of replication for the targeted bacteria. Origins of replication known in the art have been identified from species-specific plasmid DNAs (e.g. ColE1, RI, pT181, pSC101, pMB1, R6K, RK2, p15a and the like), from bacterial virus (e.g. φX174, M13, F1 and P4) and from bacterial chromosomal origins of replication (e.g. oriC).

In one embodiment, the vector according to the invention comprises a bacterial origin of replication that is functional in the targeted bacteria.

Alternatively, the vector according to the invention does not comprise any functional bacterial origin of replication or contain an origin of replication that is inactive in the targeted bacteria. Thus, the vector of the invention cannot replicate by itself once it has been introduced into a bacterium by the bacterial virus particle.

In one embodiment, the origin of replication on the vector to be packaged is inactive in the targeted bacteria, meaning that this origin of replication is not functional in the bacteria targeted by the bacterial virus particles, thus preventing unwanted vector replication.

In one embodiment, the vector comprises a bacterial origin of replication that is functional in the bacteria used for the production of the bacterial virus particles.

Bacteria-Specific Origins of Replication

Plasmid replication depends on host enzymes and on plasmid-controlled cis and trans determinants. For example, some plasmids have determinants that are recognized in almost all gram-negative bacteria and act correctly in each host during replication initiation and regulation. Other plasmids possess this ability only in some bacteria (Kues, U and Stahl, U 1989 Microbiol Rev 53:491-516).

Plasmids are replicated by three general mechanisms, namely theta type, strand displacement, and rolling circle (reviewed by Del Solar et al. 1998 Microhio and Molec Biol. Rev 62:434-464) that start at the origin of replication. This replication origins contain sites that are required for interactions of plasmid and/or host encoded proteins.

Origins of replication used on the vector of this invention may be moderate copy number, such as ColE1 ori from pBR322 (15-20 copies per cell) or the R6K plasmid (15-20 copies per cell) or may be high copy number, e.g. pUC oris (500-700 copies per cell), pGEM oris (300-400 copies per cell), pTZ oris (>1000 copies per cell) or pBluescript oris (300-500 copies per cell).

In one embodiment, the bacterial origin of replication is selected in the group consisting of ColE1, pMB1 and variants (pBR322, pET, pUC, etc), p15a, ColA, ColE2, pOSAK, pSC101, R6K, IncW (pSa etc), IncFII, pT181, P1, F IncP, IncC, IncJ, IncN, IncP1, IncP4, IncQ, IncH11, RSF1010, CloDF13, NTP16, R1, f5, pPS10, pC194, pE194, BBR1, pBC1, pEP2, pWVO1, pLF1311, pAP1, pWKS1, pLS1, pLS11, pUB6060, pJD4, pIJ101, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

More preferably, the bacterial origin of replication is an *E. coli* origin of replication selected in the group consisting of ColE1, pMB1 and variants (pBR322, pET, pUC, etc), p15a, ColA, ColE2, pOSAK, pSC101, R6K, IncW (pSa etc), IncFII, pT181, P1, F IncP, IncC, IncJ, IncN, IncP1, IncP4, IncQ, IncH11, RSF1010, CloDF13, NTP16, R1, f5, pPS10.

More preferably, the bacterial origin of replication is selected in the group consisting of pC194, pE194, BBR1, pBC1, pEP2, pWVO1, pLF1311, pAP1, pWKS1, pLS1, pLS11, pUB6060, pJD4, pIJ101, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

Even more preferably, the bacterial origins of replication are ColE1 and p15a.

In one embodiment, the bacterial origin of replication is functional in *Propionibacterium* and Cutibacterium more specifically in *Propionibacterium freudenreichii* and *Cutibacterium acnes* and is selected from the group consisting of pLME108, pLME106, p545, pRGO1, pZGX01, pPG01, pYS1, FRJS12-3, FRJS25-1, pIMPLE-HL096PA1, A_15_1_R1.

Phage Origin of Replication

The vector according to the invention may comprise a phage replication origin which can initiate, with complementation in cis or in trans of a complete or modified phage genome, the replication of the payload for later encapsulation into the different capsids.

The phage origin can also be engineered to act as a bacterial origin of replication without the need to package any phage particles.

A phage origin of replication comprised in the payload of the invention can be any origin of replication found in a phage.

Preferably, the phage origin of replication can be the wild-type or non-wildtype sequence of the M13, f1, φX174, P4, Lambda, P2, 186, Lambda-like, HK022, mEP237, HK97, HK629, HK630, mEP043, mEP213, mEP234, mEP390, mEP460, mEPx1, mEPx2, phi80, mEP234, T2, T4, T5, T7, RB49, phiX174, R17, PRD1 PI-like, P2-like, P22, P22-like, N15 and N15-like bacteriophages.

More preferably, the phage origin of replication is selected in the group consisting of phage origins of replication of M13, f1, φX174, P4, and Lambda.

In a particular embodiment, the phage origin of replication is the P4 origin of replication.

In a particular embodiment, the phage origin of replication is from *Propionibacterium* phages: BW-like phages such as Doucette, B22, E6, G4, BV-like phages such as Anatole, E1, B3, BX-like phages such as PFR1 and PFR2, filamentous B5 phage, BU-like phages (*Cutibacterium acnes* phages).

Conditional Origin of Replication

In a particular embodiment, the vector comprises a conditional origin of replication which is inactive in the targeted bacteria but is active in a donor bacterial cell.

In the context of the invention, a "conditional origin of replication" refers to an origin of replication whose functionality may be controlled by the presence of a specific molecule.

In a particular embodiment, the conditional origin of replication is an origin of replication, the replication of which depends upon the presence of one or more given protein, peptid, RNA, nucleic acid, molecule or any combination thereof.

In a particular embodiment, the replication of said origin of replication may further depend on a process, such as transcription, to activate said replication.

In the context of the invention, said conditional origin of replication is inactive in the targeted bacteria because of the absence of said given protein, peptid, RNA, nucleic acid, molecule or any combination thereof in said targeted bacteria.

In a particular embodiment, said conditional origin of replication is active in said donor bacterial cell because said donor bacterial cell expresses said given protein, peptid, RNA, nucleic acid, molecule or any combination thereof. In a particular embodiment, said protein, peptid, RNA nucleic acid, molecule or any combination thereof is expressed in trans in said donor bacterial cell.

By "in trans" is meant herein that said protein, peptid, RNA, nucleic acid, molecule or any combination thereof is not encoded on the same nucleic acid molecule as the one comprising the origin of replication. In a particular embodiment, said protein, peptid, RNA, nucleic acid, molecule or any combination thereof is encoded on a chromosome or on a vector, in particular a plasmid. In a particular embodiment, said vector comprises an antibiotic resistance marker. In an alternative embodiment, said vector is devoid of antibiotic resistance marker.

Since said conditional origin of replication is inactive in the targeted bacteria because of the absence of said given protein, peptid, RNA, nucleic acid, molecule or any combination thereof in said targeted bacteria, said conditional origin of replication may be selected depending on the specific bacteria to be targeted.

The conditional origin of replication disclosed herein may originate from plasmids, bacteriophages or PICIs which preferably share the following characteristics: they contain in their origin of replication repeat sequences, or iterons, and they code for at least one protein interacting with said origin of replication (i.e. Rep, protein O, protein P, pri) which is specific to them.

By way of example, mention may be made of the conditional replication systems of the following plasmids and bacteriophages: RK2, R1, pSC101, F, Rts1, RSF1010, P1, P4, lambda, phi82, phi80.

In a particular embodiment, said conditional origin of replication is selected from the group consisting of the R6KA DNA replication origin and derivatives thereof, the IncPα oriV origin of replication and derivatives thereof, ColE1 origins of replication modified to be under an inducible promoter, and origins of replication from phage-inducible chromosomal islands (PICIs) and derivatives thereof.

In a particular embodiment, said conditional origin of replication is an origin of replication present in less than 50%, or less than 40%, less than 30%, less than 20%, less than 10% or less than 5% of the bacteria of the host microbiome.

In another particular embodiment, said conditional origin of replication comprises or consists of a sequence less than 80% identical, in particular less than 70%, less than 60%, less than 50%, less than 40%, less than 30%, less than 20%, less than 10%, less than 5% or less than 1% identical to the sequences of the origins of replication of the bacteria of the host microbiome, in particular of the bacteria representing more than 50%, more particularly more than 60%, more than 70%, more than 80%, more than 90% or more than 95% of the host microbiome.

As used herein, the term "phage-inducible chromosomal islands" or "PICIs" refers to mobile genetic elements having a conserved gene organization, and encode a pair of divergent regulatory genes, including a PICI master repressor. Typically, in Gram-positive bacteria, left of rpr, and transcribed in the same direction, PICIs encode a small set of genes including an integrase (int) gene; right of rpr, and transcribed in the opposite direction, the PICIs encode an excision function (xis), and a replication module consisting of a primase homolog (pri) and optionally a replication initiator (rep), which are sometimes fused, followed by a replication origin (ori), next to these genes, and also transcribed in the same direction, PICIs encode genes involved in phage interference, and optionally, a terminase small subunit homolog (terS).

In a particular embodiment, said conditional origin of replication is an origin of replication derived from phage-inducible chromosomal islands (PICIs).

A particular conditional origin of replication has indeed been derived from PICIs.

It was shown that it is possible to derive novel conditionally replicative vectors, in particular based on the primase-helicase and origin of replication from PICIs. These origins may be relatively rare in target strains, and more advantageously the primase-ori pair may be unique for each PICI, significantly reducing the possibility of undesired recombination or payload spread events. They can further be modified to further limit recombination chances and remove restriction sites to bypass target bacteria defense systems.

In a particular embodiment, said conditional origin of replication is derived from the origin of replication from the PICI of the *Escherichia coli* strain CFT073, disclosed in Fillol-Salom et al. (2018) *The ISME Journal* 12:2114-2128.

In a particular embodiment, said conditional origin of replication is the primase ori from the PICI of the *Escherichia coli* strain CFT073, typically of sequence SEQ ID NO: 12.

In another particular embodiment, said conditional origin of replication is the primase ori from the PICI of the *Escherichia coli* strain CFT073, devoid of at least 1, at least 2, at least 3, at least 4, at least 5, at least 6, at least 7, at least 8, at least 9, at least 10, at least 11, at least 12, at least 13, at least 14, at least 15 or at least 16 restriction site(s) selected from the group consisting of GAAABCC, GCCGGC, RCCGGY, GCNGC, TWCANNNNNNTGG (SEQ ID NO: 13), TGGCCA, ACCYAC, YGGCCR, AGACC, GCWGC, GGGANGC, GKAGATD, GCCGGYYD, GGCYAC, RGCCGGYYD, and VGCCGGYBD.

In a particular embodiment, said conditional origin of replication is the primase ori from the PICI of the *Escherichia coli* strain CFT073, devoid of the restriction site GAAABCC. Preferably, said conditional origin of replication is of sequence SEQ ID NO: 7.

In another particular embodiment, said conditional origin of replication is the primase ori from the PICI of the *Escherichia coli* strain CFT073 devoid of the restriction sites GAAABCC, GCCGGC, RCCGGY, GCNGC, TWCANNNNNNTGG (SEQ ID NO: 13), TGGCCA, ACCYAC, YGGCCR, AGACC, GCWGC, GGGANGC, GKAGATD, GCCGGYYD, GGCYAC, RGCCGGYYD, and VGCCGGYBD. Preferably, said conditional origin of replication is of sequence SEQ ID NO: 8.

In a particular embodiment, wherein said origin of replication is derived from phage-inducible chromosomal islands (PICIs), said conditional origin of replication is active in said donor bacterial cell because said donor bacterial cell expresses a rep protein, in particular a primase-helicase, in particular a primase-helicase of sequence SEQ ID NO: 14, typically encoded by a nucleic acid comprising or consisting of the sequence SEQ ID NO: 15.

It was demonstrated that these specific conditional origins of replication were particularly compatible with lambda-based packaging, leading to sufficiently high titers ($>10^{10}$/mL) required for microbiota-related applications.

In a particular embodiment, when said vector is a phagemid, said origin of replication may be derived from a microorganism which is different from the one that is used to encode the structural elements of the capsid packaging said phagemid.

By "donor bacterial cell" is meant herein a bacterium that is capable of hosting a vector as defined above, of producing a vector as defined above and/or which is capable of transferring said vector as defined above to another bacterium. In a particular embodiment, said vector may be a phagemid, and said donor bacterial cell may then be a bacterial cell able to produce said phagemid, more particularly in the form of a packaged phagemid. In an alternative embodiment, said vector may be a plasmid, more particularly a conjugative plasmid, and said donor bacterial cell may then be a bacterium that is capable of transferring said conjugative plasmid to another bacterium, in particular by conjugation.

Preferably, said donor bacterial cell stably comprises said vector and is able to replicate said vector.

In a particular embodiment, when the conditional origin of replication of said vector is an origin of replication, the replication of which depends upon the presence of a given protein, peptid, nucleic acid, RNA, molecule or any combination thereof, said donor bacterial cell expresses said protein, peptid, nucleic acid, RNA, molecule or any combination thereof. Preferably, said protein, peptid, nucleic acid, RNA, molecule or any combination thereof is expressed in trans, as defined above.

In a particular embodiment, said donor bacterial cell stably comprises a nucleic acid encoding said protein, peptid, nucleic acid, RNA, molecule or any combination thereof.

In a particular embodiment, when said origin of replication is derived from phage-inducible chromosomal islands (PICIs), said conditional origin of replication is active in said donor bacterial cell because said donor bacterial cell expresses a rep protein, in particular a primase-helicase, in particular a primase-helicase of sequence SEQ ID NO: 14.

In a particular embodiment, said donor bacterial cell stably comprises a nucleic acid encoding said rep protein, in particular said primase-helicase, said nucleic acid typically comprising or consisting of the sequence SEQ ID NO: 15.

In a particular embodiment, said donor bacterial cell is a production cell line, in particular a cell line producing packaged phagemids including the vector of the invention.

Generation of packaged phagemids and bacteriophage particles by production cell lines are routine techniques well-known to one skilled in the art. In an embodiment, a satellite phage and/or helper phage may be used to promote the packaging of the vector in the delivery vehicles disclosed herein. Helper phages provide functions in trans and are well known to the man skilled in the art. The helper phage comprises all the genes coding for the structural and functional proteins that are indispensable for the phagemid to be packaged, (i.e. the helper phage provides all the necessary gene products for the assembly of the delivery vehicle). The helper phage may contain a defective origin of replication or packaging signal, or completely lack the latter, and hence it is incapable of self-packaging, thus only bacterial delivery particles carrying the vector or plasmid will be produced. Helper phages may be chosen so that they cannot induce lysis of the bacterial cells used for the delivery particle production. One skilled in the art would understand that some bacteriophages are defective and need a helper phage for payload packaging. Thus, depending on the bacteriophage chosen to prepare the bacterial delivery particles, the person skilled in the art would know if a helper phage is required. Sequences coding for one or more proteins or regulatory processes necessary for the assembly or production of packaged payloads may be supplied in trans. For example, STF, gpJ and gpH proteins may be provided in a vector or plasmid under the control of an inducible promoter or expressed constitutively. In this case, the phage wild-type sequence may or not contain a deletion of the gene or sequence supplied in trans. Additionally, chimeric or modified phage sequences encoding a new function, like an engineered STF, gpJ or gpH protein, may be directly inserted into the desired position in the genome of the helper phage, hence bypassing the necessity of providing the modified sequence in trans. Methods for both supplying a sequence or protein in trans in the form of a vector or plasmid, as well as methods to generate direct genomic insertions, modifications and mutations are well known to those skilled in the art.

Delivery Vehicle Incapable of Self-Reproduction

In a particular embodiment, the delivery vehicle, in particular the bacteriophage, bacterial virus particle or packaged phagemid, comprising the vector of the invention is incapable of self-reproduction.

In the context of the present invention, "self-reproduction" is different from "self-replication", "self-replication" referring to the capability of replicating a nucleic acid, whereas "self-reproduction" refers to the capability of having a progeny, in particular of producing new delivery vehicles, said delivery vehicles being either produced empty or with a nucleic acid of interest packaged.

By "delivery vehicle incapable of self-reproduction" is meant herein that at least one, several or all functional gene(s) necessary to produce said delivery vehicle is(are) absent from said delivery vehicle (and from said vector included in said delivery vehicle). In a preferred embodiment, said at least one, several or all functional gene(s) necessary to produce said delivery vehicle is(are) present in the donor cell as defined above, preferably in a plasmid, in the chromosome or in a helper phage present in the donor cell as defined above, enabling the production of said delivery vehicle in said donor cell.

In the context of the invention, said functional gene necessary to produce delivery vehicle may be absent through (i) the absence of the corresponding gene or (ii) the presence of the corresponding gene but in a non-functional form.

In an embodiment, the sequence of said gene necessary to produce said delivery vehicle is absent from said delivery vehicle. In a preferred embodiment, the sequence of said gene necessary to produce said delivery vehicle has been replaced by a nucleic acid sequence of interest, in particular by a nucleic acid sequence encoding enzymes or systems for inducing genetic modifications, as defined above.

Alternatively, said gene necessary to produce said delivery vehicle is present in said delivery vehicle in a non-functional form, for example in a mutant non-functional form, for example with deleted or mutated non-functional regulators. In a preferred embodiment, said gene necessary to produce said delivery vehicle is present in said delivery vehicle in a mutated form which renders it non-functional in the target cell, while remaining functional in the donor cell.

In the context of the invention, genes necessary to produce said delivery vehicle encompass any coding or non-coding nucleic acid required for the production of said delivery vehicle.

Examples of genes necessary to produce said delivery vehicle include genes encoding phage structural proteins; phage genes involved in the control of genetic expression; phage genes involved in transcription and/or translation regulation; phage genes involved in phage DNA replication; phage genes involved in production of phage proteins; phage genes involved in phage proteins folding; phage genes involved in phage DNA packaging; and phage genes encoding proteins involved in bacterial cell lysis.

Sequence of Interest Under the Control of the Promoter

The vector can comprise a sequence of interest under the control of at least one promoter.

In one embodiment, the sequence of interest is a programmable nuclease circuit to be delivered to the targeted bacteria. This programmable nuclease circuit may be able to mediate in vivo sequence-specific elimination of bacteria that contain a target gene of interest (e.g. a gene that is harmful to humans). Some embodiments of the present disclosure relate to engineered variants of the Type II CRISPR-Cas (Clustered Regularly Interspaced Short Palindromic Repeats-CRISPR-associated) system of *Streptococcus pyogenes*. Other programmable nucleases that can be used include other CRISPR-Cas systems, engineered TALEN (Transcription Activator-Like Effector Nuclease) variants, engineered zinc finger nuclease (ZFN) variants, natural, evolved or engineered meganuclease or recombinase variants, and any combination or hybrids of programmable nucleases. Thus, the engineered autonomously distributed circuits provided herein may be used to selectively modify DNA encoding a gene of interest such as, for example, a toxin gene, a virulence factor gene, an antibiotic resistance gene, a remodeling gene or a modulatory gene (cf. WO2014124226 and US2015/0064138).

Other sequences of interest, preferably programmable, can be added to the vector so as to be delivered to targeted bacteria.

Preferably, the sequence of interest circuit added to the payload does not lead to bacteria death. For example, the sequence of interest may encode reporter genes leading to a luminescence or fluorescence signal. Alternatively, the sequence of interest may comprise proteins and enzymes achieving a useful function such as modifying the metabolism of the bacteria, the composition of its environment or affecting the host. More specifically the sequence of interest might be an antigen triggering a host immune response. The specific antigen can be released in the environment after induction of the lysis of the target cell or can be secreted by the target cell, for example, as described in Costa et al[22] and Anné et al[23].

In a particular embodiment, the nucleic acid sequence of interest is selected from the group consisting of a Cas nuclease, a Cas9 nuclease, a guide RNA, a single guide RNA (sgRNA), a CRISPR locus, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor and a gene expressing a virulence protein or a virulence factor, a bacterial secretory protein or transporter, a bacterial pore or any of their combination. These proteins can also be modified or engineered to include extra features, like the addition or removal of a function (e.g. dCas9), the addition of a secretion signal to a protein not normally secreted, the addition of an exogenous peptide in a loop as non-limiting examples.

Targeted Bacteria

The bacteria targeted by the vectors, delivery particles, bacteriophages, donor cells, bacterial virus particles or packaged phagemids can be any bacteria present in a mammal organism, a plant or in the environment. It can be any commensal, symbiotic or pathogenic bacteria of the microbiota or microbiome.

A microbiome may comprise a variety of endogenous bacterial species, any of which may be targeted in accordance with the present disclosure. In some embodiments, the genus and/or species of targeted endogenous bacterial cells may depend on the type of bacteriophages being used for preparing the bacterial virus particles. For example, some bacteriophages exhibit tropism for, or preferentially target, specific host species of bacteria. Other bacteriophages do not exhibit such tropism and may be used to target a number of different genus and/or species of endogenous bacterial cells.

Examples of bacterial cells include, without limitation, cells from bacteria of the genus *Yersinia* spp., *Escherichia* spp., *Klebsiella* spp., *Acinetobacter* spp., *Bordetella* spp., *Neisseria* spp., *Aeromonas* spp., *Franciesella* spp., *Corynebacterium* spp., *Citrobacter* spp., *Chlamydia* spp., *Hemophilus* spp., *Brucella* spp., *Mycobacterium* spp., *Legionella* spp., *Rhodococcus* spp., *Pseudomonas* spp., *Helicobacter* spp., *Vibrio* spp., *Bacillus* spp., *Erysipelothrix* spp., *Salmonella* spp., *Streptomyces* spp., *Streptococcus* spp., *Staphylococcus* spp., *Bacteroides* spp., *Prevotella* spp., *Clostridium* spp., *Bifidobacterium* spp., *Clostridium* spp., *Brevibacterium* spp., *Lactococcus* spp., *Leuconostoc* spp., *Actinobacillus* spp., *Selnomonas* spp., *Shigella* spp., *Zymonas* spp., *Mycoplasma* spp., *Treponema* spp., *Leuconostoc* spp., *Corynebacterium* spp., *Enterococcus* spp., *Enterobacter* spp., *Pyrococcus* spp., *Serratia* spp., *Morganella* spp., *Parvimonas* spp., *Fusobacterium* spp., *Actinomyces* spp., *Porphyromonas* spp., *Micrococcus* spp., *Bartonella* spp., *Borrelia* spp., *Brucelia* spp., *Campylobacter* spp., *Chlamydophilia* spp., *Cutibacterium* spp., *Propionibacterium* spp., *Gardnerella* spp., *Ehrlichia* spp., *Haemophilus* spp., *Leptospira* spp., *Listeria* spp., *Mycoplasma* spp., *Nocardia* spp., *Rickettsia* spp., *Ureaplasma* spp., *Lactobacillus* spp. and a mixture thereof.

Thus, vectors, delivery particles, bacteriophages, bacterial virus particles or packaged phagemids may target (e.g., specifically target) a bacterial cell from any one or more of the foregoing genus of bacteria to specifically deliver the payload according to the invention.

Preferably, the targeted bacteria can be selected from the group consisting of *Yersinia* spp., *Escherichia* spp., *Klebsiella* spp., *Acinetobacter* spp., *Pseudomonas* spp., *Helicobacter* spp., *Vibrio* spp, *Salmonella* spp., *Streptococcus* spp., *Staphylococcus* spp., *Bacteroides* spp., *Clostridium* spp., *Shigella* spp., *Enterococcus* spp., *Enterobacter* spp., *Listeria* spp., *Cutibacterium* spp., *Propionibacterium* spp., *Fusobacterium* spp., *Porphyromonas* spp. and *Gardnerella* spp.

In some embodiments, bacterial cells of the present invention are anaerobic bacterial cells (e.g., cells that do not require oxygen for growth). Anaerobic bacterial cells include facultative anaerobic bacterial cells such as but not limited to *Escherichia coli, Shewanella oneidensi, Gardnerella vaginalis* and *Listeria*. Anaerobic bacterial cells also include obligate anaerobic cells such as, for example, *Bacteroides, Clostridium, Cutibacterium, Propionibacterium, Fusobacterium* and *Porphyromonas* species. In humans, anaerobic bacteria are most commonly found in the gastrointestinal tract. In some particular embodiment, the targeted bacteria are thus bacteria most commonly found in the gastrointestinal tract. Bacteriophages used for preparing the bacterial virus particles, and then the bacterial virus particles, may target (e.g., to specifically target) anaerobic bacterial cells according to their specific spectra known by the person skilled in the art to specifically deliver the payload.

In some embodiments, the targeted bacterial cells are, without limitation, *Bacteroides faecis, Bacteroides thetaiotaomicron, Bacteroides fragilis, Bacteroides distasonis, Bacteroides vulgatus, Clostridium leptum, Clostridium coccoides, Staphylococcus aureus, Bacillus subtilis, Clostridium butyricum, Brevibacterium lactofermentum, Streptococcus agalactiae, Lactococcus lactis, Leuconostoc lactis, Actinobacillus* actinobycetemcomitans, cyanobacteria, *Escherichia coli, Helicobacter pylori, Selnomonas ruminatium, Shigella sonnei, Zymomonas mobilis, Mycoplasma mycoides, Treponema denticola, Bacillus thuringiensis, Staphiococcus lugdunensis, Leuconostoc oenos, Corynebacterium xerosis, Lactobacillus plantarum, Lactobacillus rhamnosus, Lactobacillus casei, Lactobacillus acidophilus, Enterococcus faecalis, Bacillus coagulans, Bacillus cereus, Bacillus popillae, Synechocystis* strain PCC6803, *Bacillus liquefaciens, Pyrococcus abyssi, Selenomonas nominantium, Lactobacillus hilgardii, Streptococcus ferus, Lactobacillus pentosus, Bacteroides fragilis, Staphylococcus epidermidis, Streptomyces phaechromogenes, Streptomyces ghanaenis, Klebsiella pneumoniae, Enterobacter cloacae, Enterobacter aerogenes, Serratia marcescens, Morganella morganii, Citrobacter freundii, Propionibacterium freudenreichii, Pseudomonas* aerigunosa, *Parvimonas micra, Prevotella intermedia, Fusobacterium nucleatum, Prevotella nigrescens, Actinomyces israelii, Porphyromonas endodontalis, Porphyromonas gingivalis Micrococcus luteus, Bacillus megaterium, Aeromonas hydrophila, Aeromonas caviae, Bacillus anthracis, Bartonella henselae, Bartonella Quintana, Bordetella pertussis, Borrelia burgdorferi, Borrelia garinii, Borrelia afzelii, Borrelia recurrentis, Brucella abortus, Brucella canis, Brucella melitensis, Brucella suis, Campylobacter jejuni, Campylobacter coli, Campylobacter fetus, Chlamydia pneumoniae, Chlamydia trachomatis, Chlamydophila psittaci, Clostridium botulinum, Clostridium difficile, Clostridium perfringens, Clostridium tetani, Corynebacterium diphtheria, Cutibacterium acnes* (formerly *Propionibacterium acnes*), *Ehrlichia canis, Ehrlichia chaffeensis, Enterococcus faecium, Francisella tularensis, Haemophilus influenza, Legionella pneumophila, Leptospira interrogans, Leptospira santarosai, Leptospira weilii, Leptospira noguchii, Listeria monocytogenes, Mycobacterium leprae, Mycobacterium tuberculosis, Mycobacterium ulcerans, Mycoplasma pneumonia, Neisseria gonorrhoeae, Neisseria meningitides, Nocardia asteroids, Rickettsia rickettsia, Salmonella enteritidis, Salmonella typhi, Salmonella paratyphi, Salmonella typhimurium, Shigella flexnerii, Shigella dysenteriae, Staphylococcus saprophyticus, Streptococcus pneumoniae, Streptococcus pyogenes, Gardnerella vaginalis, Streptococcus viridans,*

*Treponema pallidum, Ureaplasma urealyticum, Vibrio cholera, Vibrio parahaemolyticus, Yersinia pestis, Yersinia enterocolitica, Yersinia pseudotuberculosis, Actinobacter baumanii, Pseudomonas aerigunosa*, and a mixture thereof, preferably the bacteria of interest are selected from the group consisting of *Escherichia coli, Enterococcus faecium, Staphylococcus aureus, Klebsiella pneumoniae, Acinetobacter baumanii, Pseudomonas aeruginosa, Enterobacter cloacae*, and *Enterobacter aerogenes*, and a mixture thereof.

In some embodiments, the targeted bacterial cells are, without limitation, *Anaerotruncus, Acetanaerobacterium, Acetitomaculum, Acetivibrio, Anaerococcus, Anaerofilum, Anaerosinus, Anaerostipes, Anaerovorax, Butyrivibrio, Clostridium, Capracoccus, Dehalobacter, Dialister, Dorea, Enterococcus, Ethanoligenens, Faecalibacterium, Fusobacterium, Gracilibacter, Guggenheimella, Hespellia, Lachnobacterium, Lachnospira, Lactobacillus, Leuconostoc, Megamonas, Moryella, Mitsuokella, Oribacterium, Oxobacter, Papillibacter, Proprionispira, Pseudobutyrivibrio, Pseudoramibacter, Roseburia, Ruminococcus, Sarcina, Seinonella, Shuttleworthia, Sporobacter, Sporobacterium, Streptococcus, Subdoligranulum, Syntrophococcus, Thermobacillus, Turibacter, Weisella, Clostridium, Bacteroides, Ruminococcus, Faecalibacterium, Treponema, Phascolarctobacterium, Megasphaera, Faecalibacterium, Bifidobacterium, Lactobacillus, Sutterella*, and/or *Prevotella*.

In other embodiments, the targeted bacteria cells are, without limitation, *Achromobacter xylosoxidans, Acidaminococcus fermentans, Acidaminococcus intestini, Acidaminococcus* sp., *Acinetobacter baumannii, Acinetobacter junii, Acinetobacter lwoffii, Actinobacillus capsulatus, Actinomyces naeslundii, Actinomyces neuii, Actinomyces odontolyticus, Actinomyces radingae, Adlercreutzia equolifaciens, Aeromicrobium massiliense, Aggregatibacter actinomycetemcomitans, Akkermansia muciniphila, Aliagarivorans marinus, Alistipes finegoldii, Alistipes indistinctus, Alistipes inops, Alistipes onderdonkii, Alistipes putredinis, Alistipes senegalensis, Alistipes shahii, Alistipes timonensis, Alloscardovia omnicolens, Anaerobacter polyendosporus, Anaerobaculum hydrogeniformans, Anaerococcus hydrogenalis, Anaerococcus prevotii, Anaerococcus senegalensis, Anaerofustis stercorihominis, Anaerostipes caccae, Anaerostipes hadrus, Anaerotruncus colihominis, Aneurinibacillus aneurinilyticus, Bacillus licheniformis, Bacillus massilioanorexius, Bacillus massiliosenegalensis, Bacillus simplex, Bacillus smithii, Bacillus subtilis, Bacillus thuringiensis, Bacillus timonensis, Bacteroides xylanisolvens, Bacteroides acidifaciens, Bacteroides caccae, Bacteroides capillosus, Bacteroides cellulosilyticus, Bacteroides clarus, Bacteroides coprocola, Bacteroides coprophilus, Bacteroides dorei, Bacteroides eggerthii, Bacteroides faecis, Bacteroides finegoldii, Bacteroides fluxus, Bacteroides fragilis, Bacteroides gallinarum, Bacteroides intestinalis, Bacteroides nordii, Bacteroides oleiciplenus, Bacteroides ovatus, Bacteroides pectinophilus, Bacteroides plebeius, Bacteroides salanitronis, Bacteroides salyersiae, Bacteroides* sp., *Bacteroides stercoris, Bacteroides thetaiotaomicron, Bacteroides uniformis, Bacteroides vulgatus, Bacteroides xylanisolvens,* Bacteroidespectinophilus ATCC, *Barnesiella intestinihominis, Bavariicoccus seileri, Bifidobacterium adolescentis, Bifidobacterium angulatum, Bifidobacterium animalis, Bifidobacterium bifidum, Bifidobacterium breve, Bifidobacterium catenulatum, Bifidobacterium dentium, Bifidobacterium gallicum, Bifidobacterium longum, Bifidobacterium pseudocatenulatum, Bifidobacterium stercoris, Bilophila wadsworthia, Blautia faecis, Blautia hansenii, Blautia hydrogenotrophica, Blautia luti, Blautia obeum, Blautia producta, Blautia wexlerae, Brachymonas chironomi, Brevibacterium senegalense, Bryantella formatexigens,* butyrate-producing bacterium, *Butyricicoccus pullicaecorum, Butyricimonas virosa, Butyrivibrio crossotus, Butyrivibrio fibrisolvens, Caldicoprobacter faecalis, Campylobacter concisus, Campylobacter jejuni, Campylobacter upsaliensis, Catenibacterium mitsuokai, Cedecea davisae, Cellulomonas massiliensis, Cetobacterium somerae, Citrobacter braakii, Citrobacter freundii, Citrobacter pasteurii, Citrobacter* sp., *Citrobacter youngae, Cloacibacillus evryensis, Clostridiales bacterium, Clostridioides difficile, Clostridium asparagiforme, Clostridium bartlettii, Clostridium boliviensis, Clostridium bolteae, Clostridium hathewayi, Clostridium hiranonis, Clostridium hylemonae, Clostridium leptum, Clostridium methylpentosum, Clostridium nexile, Clostridium orbiscindens, Clostridium ramosum, Clostridium scindens, Clostridium sp, Clostridium* sp., *Clostridium spiroforme, Clostridium sporogenes, Clostridium symbiosum, Collinsella aerofaciens, Collinsella intestinalis, Collinsella stercoris, Collinsella tanakaei, Coprobacillus cateniformis, Coprobacter fastidiosus, Coprococcus catus, Coprococcus comes, Coprococcus eutactus, Corynebacterium ammoniagenes, Corynebacterium amycolatum, Corynebacterium pseudodiphtheriticum, Cutibacterium acnes, Dermabacter hominis, Desulfitobacterium hafniense, Desulfovibrio fairfieldensis, Desulfovibrio piger, Dialister succinatiphilus, Dielma fastidiosa, Dorea formicigenerans, Dorea longicatena, Dysgonomonas capnocytophagoides, Dysgonomonas gadei, Dysgonomonas mossii, Edwardsiella tarda, Eggerthella lenta, Eisenbergiella tayi, Enorma massiliensis, Enterobacter aerogenes, Enterobacter asburiae, Enterobacter cancerogenus, Enterobacter cloacae, Enterobacter massiliensis, Enterococcus casseliflavus, Enterococcus durans, Enterococcus faecalis, Enterococcus faecium, Enterococcus flavescens, Enterococcus gallinarum, Enterococcus* sp., *Enterovibrio nigricans, Erysipelatoclostridium ramosum, Escherichia coli, Escherichia* sp., *Eubacterium biforme, Eubacterium dolichum, Eubacterium hallii, Eubacterium limosum, Eubacterium ramulus, Eubacterium rectale, Eubacterium siraeum, Eubacterium ventriosum, Exiguobacterium marinum, Exiguobacterium undae, Faecalibacterium cf, Faecalibacterium prausnitzii, Faecalitalea cylindroides, Ferrimonas balearica, Finegoldia magna, Flavobacterium daejeonense, Flavonifractor plautii, Fusicatenibacter saccharivorans, Fusobacterium gonidiaformans, Fusobacterium mortiferum, Fusobacterium necrophorum, Fusobacterium nucleatum, Fusobacterium periodonticum, Fusobacterium* sp., *Fusobacterium ulcerans, Fusobacterium varium, Gallibacterium anatis, Gemmiger formicilis, Gordonibacter pamelaeae, Hafnia alvei, Helicobacter bilis, Helicobacter bills, Helicobacter canadensis, Helicobacter canis, Helicobacter cinaedi, Helicobacter macacae, Helicobacter pametensis, Helicobacter pullorum, Helicobacter pylori, Helicobacter rodentium, Helicobacter winghamensis, Herbaspirillum massiliense, Holdemanella biformis, Holdemania fdiformis, Holdemania filiformis, Holdemania massiliensis, Holdemaniafiliformis, Hungatella hathewayi, Intestinibacter bartlettii, Intestinimonas butyriciproducens, Klebsiella oxytoca, Klebsiella pneumoniae, Kurthia massiliensis, Lachnospira pectinoschiza, Lactobacillus acidophilus, Lactobacillus amylolyticus, Lactobacillus animalis, Lactobacillus antri, Lactobacillus brevis, Lactobacillus buchneri, Lactobacillus casei, Lactobacillus curvatus, Lactobacillus delbrueckii, Lactobacillus fermentum, Lactobacillus gasseri, Lactobacillus helveticus, Lactobacillus hilgardii, Lactobacillus iners, Lactobacillus intestinalis,*

*Lactobacillus johnsonii, Lactobacillus murinus, Lactobacillus paracasei, Lactobacillus plantarum, Lactobacillus reuteri, Lactobacillus rhamnosus, Lactobacillus ruminis, Lactobacillus sakei, Lactobacillus salivarius, Lactobacillus ultunensis, Lactobacillus vaginalis, Lactobacillus plantarum* subsp., *Leuconostoc mesenteroides, Leuconostoc pseudomesenteroides, Listeria grayi, Listeria innocua, Mannheimia granulomatis, Marvinbryantia formatexigens, Megamonas funiformis, Megamonas hypermegale, Methanobrevibacter smithii, Methanobrevibacter smithii F1, Micrococcus luteus, Microvirgula aerodenitrificans, Mitsuokella jalaludinii, Mitsuokella multacida, Mollicutes bacterium, Murimonas intestini, Neisseria macacae, Nitriliruptor alkaliphilus, Oceanobacillus massiliensis, Odoribacter laneus, Odoribacter splanchnicus, Ornithobacterium rhinotracheale, Oxalobacter formigenes, Paenibacillus* barengoltzii, *Paenibacillus chitinolyticus, Paenibacillus lautus, Paenibacillus motobuensis, Paenibacillus senegalensis, Paenisporosarcina quisquiliarum, Parabacteroides distasonis, Parabacteroides goldsteinii, Parabacteroides gordonii, Parabacteroides johnsonii, Parabacteroides merdae, Paraprevotella xylaniphila, Parasutterella excrementihominis, Parvimonas micra, Pediococcus acidilactici, Peptoclostridium difficile, Peptoniphilus harei, Peptoniphilus obesi, Peptoniphilus senegalensis, Peptoniphilus timonensis, Phascolarctobacterium succinatutens, Porphyromonas asaccharolytica, Porphyromonas uenonis, Prevotella baroniae, Prevotella bivia, Prevotella copri, Prevotella dentalis, Prevotella micans, Prevotella multisaccharivorax, Prevotella oralis, Prevotella salivae, Prevotella stercorea, Prevotella veroralis, Propionibacterium acnes, Propionibacterium avidum, Propionibacterium freudenreichii, Propionimicrobium lymphophilum, Proteus mirabilis, Proteuspenneri ATCC, Providencia alcalifaciens, Providencia rettgeri, Providencia rustigianii, Providencia stuartii, Pseudoflavonifractor capillosus, Pseudomonas aeruginosa, Pseudomonas luteola, Ralstonia pickettii, Rheinheimera perlucida, Rheinheimera texasensis, Riemerella columbina, Romboutsia lituseburensis, Roseburia faecis, Roseburia intestinalis, Roseburia inulinivorans, Ruminococcus bicirculans, Ruminococcus bromii, Ruminococcus callidus, Ruminococcus champanellensis, Ruminococcus faecis, Ruminococcus gnavus, Ruminococcus lactaris, Ruminococcus obeum, Ruminococcus sp, Ruminococcus sp., Ruminococcus torques, Sarcina ventriculi, Sellimonas intestinalis, Senegalimassilia anaerobia, Shigella sonnei, Slackia piriformis, Staphylococcus epidermidis, Staphylococcus lentus, Staphylococcus nepalensis, Staphylococcus pseudintermedius, Staphylococcus xylosus, Stenotrophomonas maltophilia, Streptococcus agalactiae, Streptococcus anginosus, Streptococcus australis, Streptococcus caballi, Streptococcus castoreus, Streptococcus didelphis, Streptococcus equinus, Streptococcus gordonii, Streptococcus henryi, Streptococcus hyovaginalis, Streptococcus infantarius, Streptococcus infantis, Streptococcus lutetiensis, Streptococcus merionis, Streptococcus mitis, Streptococcus mutans, Streptococcus oralis, Streptococcus ovis, Streptococcus parasanguinis, Streptococcus plurextorum, Streptococcus porci, Streptococcus pyogenes, Streptococcus salivarius, Streptococcus sobrinus, Streptococcus thermophilus, Streptococcus thoraltensis, Streptomyces albus, Subdoligranulum variabile, Succinatimonas hippei, Sutterella parvirubra, Sutterella wadsworthensis, Terrisporobacter glycolicus, Terrisporobacter mayombei, Thalassobacillus devorans, Timonella senegalensis, Turicibacter sanguinis, unknown* sp, *unknown* sp., *Varibaculum cambriense, Veillonella atypica, Veillonella dispar, Veillonella parvula, Vibrio cinnatiensis, Virgibacillus salexigens,* and *Weissella paramesenteroides.* In other embodiments, the targeted bacteria cells are those commonly found on the skin microbiota and are without limitation *Acetobacter farinalis, Acetobacter malorum, Acetobacter orleanensis, Acetobacter sicerae, Achromobacter anxifer, Achromobacter denitrificans, Achromobacter marplatensis, Achromobacter spanius, Achromobacter xylosoxidans* subsp. *xylosoxidans, Acidovorax konjaci, Acidovorax radicis, Acinetobacter johnsonii, Actinomadura citrea, Actinomadura coerulea, Actinomadura fibrosa, Actinomadura fulvescens, Actinomadura jiaoheensis, Actinomadura luteofluorescens, Actinomadura mexicana, Actinomadura nitritigenes, Actinomadura verrucosospora, Actinomadura yumaensis, Actinomyces odontolyticus, Actinomycetospora atypica, Actinomycetospora corticicola, Actinomycetospora rhizophila, Actinomycetospora rishiriensis, Aeromonas australiensis, Aeromonas bestiarum, Aeromonas bivalvium, Aeromonas encheleia, Aeromonas eucrenophila, Aeromonas hydrophila* subsp. *hydrophila, Aeromonas piscicola, Aeromonas popoffii, Aeromonas rivuli, Aeromonas salmonicida* subsp. *pectinolytica, Aeromonas salmonicida* subsp. *smithia, Amaricoccus kaplicensis, Amaricoccus veronensis, Aminobacter aganoensis, Aminobacter ciceronei, Aminobacter lissarensis, Aminobacter niigataensis, Ancylobacter polymorphus, Anoxybacillus flavithermus* subsp. *yunnanensis, Aquamicrobium aerolatum, Archangium gephyra, Archangium gephyra, Archangium minus, Archangium violaceum, Arthrobacter viscosus, Bacillus anthracis, Bacillus australimaris, Bacillus drentensis, Bacillus mycoides, Bacillus pseudomycoides, Bacillus pumilus, Bacillus safensis, Bacillus vallismortis, Bosea thiooxidans, Bradyrhizobium huanghuaihaiense, Bradyrhizobium japonicum, Brevundimonas aurantiaca, Brevundimonas intermedia, Burkholderia aspalathi, Burkholderia choica, Burkholderia cordobensis, Burkholderia diffusa, Burkholderia insulsa, Burkholderia rhynchosiae, Burkholderia terrestris, Burkholderia udeis, Buttiauxella gaviniae, Caenimonas terrae, Capnocytophaga gingivalis, Chitinophaga dinghuensis, Chryseobacterium gleum, Chryseobacterium greenlandense, Chryseobacterium jejuense, Chryseobacterium piscium, Chryseobacterium sediminis, Chryseobacterium tructae, Chryseobacterium ureilyticum, Chryseobacterium vietnamense, Corynebacterium accolens, Corynebacterium afermentans* subsp. *lipophilum, Corynebacterium minutissimum, Corynebacterium sundsvallense, Cupriavidus metallidurans, Cupriavidus nantongensis, Cupriavidus necator, Cupriavidus pampae, Cupriavidus yeoncheonensis, Curtobacterium flaccumfaciens, Devosia epidermidihirudinis, Devosia riboflavina, Devosia riboflavina, Diaphorobacter oryzae, Dietzia psychralcaliphila, Ensifer adhaerens, Ensifer americanus, Enterococcus malodoratus, Enterococcus pseudoavium, Enterococcus viikkiensis, Enterococcus xiangfangensis, Erwinia rhapontici, Falsirhodobacter halotolerans, Flavobacterium araucananum, Flavobacterium frigidimaris, Gluconobacter frateurii, Gluconobacter thailandicus, Gordonia alkanivorans, Halomonas aquamarina, Halomonas axialensis, Halomonas meridiana, Halomonas olivaria, Halomonas songnenensis, Halomonas variabilis, Herbaspirillum chlorophenolicum, Herbaspirillum frisingense, Herbaspirillum hiltneri, Herbaspirillum huttiense* subsp. *putei, Herbaspirillum lusitanum, Herminiimonas fonticola, Hydrogenophaga intermedia, Hydrogenophaga pseudoflava, Klebsiella oxytoca, Kosakonia sacchari, Lactobacillus delbrueckii* subsp. *bulgaricus, Lactobacillus modestisalitolerans, Lactobacillus plantarum* subsp. *argentoratensis, Lactobacillus xiangfangensis, Lechevalieria roselyniae, Lentzea albida, Lentzea*

*califomiensis, Leuconostoc carnosum, Leuconostoc citreum, Leuconostoc gelidum* subsp. *gasicomitatum, Leuconostoc mesenteroides* subsp. *suionicum, Luteimonas aestuarii, Lysobacter antibioticus, Lysobacter koreensis, Lysobacter oryzae, Magnetospirillum moscoviense, Marinomonas alcarazii, Marinomonas primoryensis, Massilia aurea, Massilia jejuensis, Massilia kyonggiensis, Massilia timonae, Mesorhizobium acaciae, Mesorhizobium qingshengii, Mesorhizobium shonense, Methylobacterium haplocladii, Methylobacterium platani, Methylobacterium pseudosasicola, Methylobacterium zatmanii, Microbacterium oxydan, Micromonospora chaiyaphumensis, Micromonospora chalcea, Micromonospora citrea, Micromonospora coxensis, Micromonospora echinofusca, Micromonospora halophytica, Micromonospora kangleipakensis, Micromonospora maritima, Micromonospora nigra, Micromonospora purpureochromogene, Micromonospora rhizosphaerae, Micromonospora saelicesensis, Micro virga subterranea, Microvirga zambiensis, Mycobacterium alvei, Mycobacterium avium* subsp. *silvaticum, Mycobacterium colombiense, Mycobacterium conceptionense, Mycobacterium conceptionense, Mycobacterium farcinogenes, Mycobacterium fortuitum* subsp. *fortuitum, Mycobacterium goodii, Mycobacterium insubricum, Mycobacterium Ilatzerense, Mycobacterium neoaurum, Mycobacterium neworleansense, Mycobacterium obuense, Mycobacterium peregrinum, Mycobacterium saopaulense, Mycobacterium septicum, Mycobacterium setense, Mycobacterium smegmatis, Neisseria subflava, Nocardia lijiangensis, Nocardia thailandica, Novosphingobium barchaimii, Novosphingobium lindaniclasticum, Novosphingobium lindaniclasticum, Novosphingobium mathurense, Ochrobactrum pseudogrignonense, Oxalicibacterium solurbis, Paraburkholderia glathei, Paraburkholderia humi, Paraburkholderia phenazinium, Paraburkholderia phytofirmans, Paraburkholderia sordidicola, Paraburkholderia terricola, Paraburkholderia xenovorans, Paracoccus laeviglucosivorans, Patulibacter ginsengiterrae, Polymorphospora rubra, Porphyrobacter colymbi, Prevotella jejuni, Prevotella melaninogenica, Propionibacterium acnes* subsp. *elongatum, Proteus vulgaris, Providencia rustigianii, Pseudoalteromonas agarivorans, Pseudoalteromonas atlantica, Pseudoalteromonas paragorgicola, Pseudomonas asplenii, Pseudomonas asuensis, Pseudomonas benzenivorans, Pseudomonas cannabina, Pseudomonas cissicola, Pseudomonas congelans, Pseudomonas costantinii, Pseudomonas ficuserectae, Pseudomonas frederiksbergensis, Pseudomonas graminis, Pseudomonas jessenii, Pseudomonas koreensis, Pseudomonas koreensis, Pseudomonas kunmingensis, Pseudomonas marginalis, Pseudomonas mucidolens, Pseudomonas panacis, Pseudomonas plecoglossicida, Pseudomonas poae, Pseudomonas pseudoalcaligenes, Pseudomonas putida, Pseudomonas reinekei, Pseudomonas rhizosphaerae, Pseudomonas seleniipraecipitans, Pseudomonas umsongensis, Pseudomonas zhaodongensis, Pseudonocardia alaniniphila, Pseudonocardia ammonioxydans, Pseudonocardia autotrophica, Pseudonocardia kongjuensis, Pseudonocardia yunnanensis, Pseudorhodoferax soli, Pseudoxanthomonas daejeonensis, Pseudoxanthomonas indica, Pseudoxanthomonas kaohsiungensis, Psychrobacter aquaticus, Psychrobacter arcticus, Psychrobacter celer, Psychrobacter marincola, Psychrobacter nivimaris, Psychrobacter okhotskensis, Psychrobacter okhotskensis, Psychrobacter piscatorii, Psychrobacter pulmonis, Ramlibacter ginsenosidimutans, Rheinheimera japonica, Rheinheimera muenzenbergensis, Rheinheimera soli, Rheinheimera tangshanensis, Rheinheimera texasensis, Rheinheimera tilapiae, Rhizobium alamii, Rhizobium azibense, Rhizobium binae, Rhizobium daejeonense, Rhizobium endophyticum, Rhizobium etli, Rhizobium fabae, Rhizobium freirei, Rhizobium gallicum, Rhizobium loessense, Rhizobium sophoriradicis, Rhizobium taibaishanense, Rhizobium vallis, Rhizobium vignae, Rhizobium vignae, Rhizobium yanglingense, Rhodococcus baikonurensis, Rhodococcus enclensis, Rhodoferax saidenbachensis, Rickettsia canadensis, Rickettsia heilongjiangensis, Rickettsia honei, Rickettsia raoultii, Roseateles aquatilis, Roseateles aquatilis, Salmonella enterica* subsp. *salamae, Serratia ficaria, Serratia myotis, Serratia vespertilionis, Shewanella aestuarii, Shewanella decolorationis, Sphingobium amiense, Sphingobium baderi, Sphingobium barthaii, Sphingobium chlorophenolicum, Sphingobium cupriresistens, Sphingobium czechense, Sphingobium fuliginis, Sphingobium indicum, Sphingobium indicum, Sphingobium japonicum, Sphingobium lactosutens, Sphingomonas dokdonensis, Sphingomonas pseudosanguinis, Sphingopyxis chilensis, Sphingopyxis fribergensis, Sphingopyxis granuli, Sphingopyxis indica, Sphingopyxis witflariensis, Staphylococcus agnetis, Staphylococcus aureus* subsp. *aureus, Staphylococcus epidermidis, Staphylococcus hominis* subsp. *novobiosepticus, Staphylococcus nepalensis, Staphylococcus saprophyticus* subsp. *bovis, Staphylococcus sciuri* subsp. *carnaticus, Streptomyces caeruleatus, Streptomyces canarius, Streptomyces capoamus, Streptomyces ciscaucasicus, Streptomyces griseorubiginosus, Streptomyces olivaceoviridis, Streptomyces panaciradicis, Streptomyces phaeopurpureus, Streptomyces pseudovenezuelae, Streptomyces resistomycificus, Tianweitania sediminis, Tsukamurella paurometabola, Variovorax guangxiensis, Vogesella alkaliphila, Xanthomonas arboricola, Xanthomonas axonopodis, Xanthomonas cassavae, Xanthomonas cucurbitae, Xanthomonas cynarae, Xanthomonas euvesicatoria, Xanthomonas fragariae, Xanthomonas gardneri, Xanthomonas perforans, Xanthomonas pisi, Xanthomonas populi, Xanthomonas vasicola, Xenophilus aerolatus, Yersinia nurmii, Abiotrophia defectiva, Acidocella aminolytica, Acinetobacter guangdongensis, Acinetobacter parvus, Acinetobacter radioresistens, Acinetobacter soli, Acinetobacter variabilis, Actinomyces cardiffensis, Actinomyces dentalis, Actinomyces europaeus, Actinomyces gerencseriae, Actinomyces graevenitzii, Actinomyces haliotis, Actinomyces johnsonii, Actinomyces massiliensis, Actinomyces meyeri, Actinomyces meyeri, Actinomyces naeslundii, Actinomyces neuii* subsp. *anitratus, Actinomyces odontolyticus, Actinomyces oris, Actinomyces turicensis, Actinomycetospora corticicola, Actinotignum schaalii, Aerococcus christensenii, Aerococcus urinae, Aeromicrobium flavum, Aeromicrobium massiliense, Aeromicrobium tamlense, Aeromonas sharmana, Aggregatibacter aphrophilus, Aggregatibactersegnis, Agrococcus baldri, Albibacter methylovorans, Alcaligenes faecalis* subsp. *faecalis, Algoriphagus ratkowskyi, Alkalibacterium olivapovliticus, Alkalibacterium pelagium, Alkalibacterium pelagium, Alloprevotella rava, Alsobacter metallidurans, Amaricoccus kaplicensis, Amaricoccus veronensis, Anaerococcus hydrogenalis, Anaerococcus lactolyticus, Anaerococcus murdochii, Anaerococcus octavius, Anaerococcus prevotii, Anaerococcus vaginalis, Aquabacterium citratiphilum, Aquabacterium olei, Aquabacterium olei, Aquabacterium parvum, Aquincola tertiaricarbonis, Arcobacter venerupis, Arsenicicoccus bolidensis, Arthrobacter russicus, Asticcacaulis excentricus, Atopobium deltae, Atopobium parvulum, Atopobium rimae, Atopobium vaginae, Aureimonas altamirensis, Aureimonas rubiginis, Azospira oryzae, Azospirillum oryzae, Bacillus circulans, Bacillus drentensis,*

Bacillus fastidiosus, Bacillus lehensis, Bacillus oceanisediminis, Bacillus rhizosphaerae, Bacteriovorax stolpii, Bacteroides coagulans, Bacteroides dorei, Bacteroides fragilis, Bacteroides ovatus, Bacteroides stercoris, Bacteroides uniformis, Bacteroides vulgatus, Bdellovibrio bacteriovorus, Bdellovibrio exovorus, Belnapia moabensis, Belnapia soli, Blautia hansenii, Blautia obeum, Blautia wexlerae, Bosea lathyri, Brachybacterium fresconis, Brachybacterium muris, Brevibacterium ammoniilyticum, Brevibacterium casei, Brevibacterium epidermidis, Brevibacterium iodinum, Brevibacterium luteolum, Brevibacterium paucivorans, Brevibacterium pityocampae, Brevibacterium sanguinis, Brevundimonas albigilva, Brevundimonas diminuta, Brevundimonas vancanneytii, Caenimonas terrae, Calidifontibacter indicus, Campylobacter concisus, Campylobacter gracilis, Campylobacter hominis, Campylobacter rectus, Campylobacter showae, Campylobacter ureolyticus, Capnocytophaga gingivalis, Capnocytophaga leadbetteri, Capnocytophaga ochracea, Capnocytophaga sputigena, Cardiobacterium hominis, Cardiobacterium valvarum, Carnobacterium divergens, Catonella morbi, Caulobacter henricii, Cavicella subterranea, Cellulomonas xylanilyfica, Cellvibrio vulgaris, Chitinimonas taiwanensis, Chryseobacterium arachidis, Chryseobacterium daecheongense, Chryseobacterium formosense, Chryseobacterium formosense, Chryseobacterium greenlandense, Chryseobacterium indologenes, Chryseobacterium piscium, Chryseobacterium rigui, Chryseobacterium solani, Chryseobacterium taklimakanense, Chryseobacterium ureilyticum, Chryseobacterium ureilyticum, Chryseobacterium zeae, Chryseomicrobium aureum, Cloacibacterium haliotis, Cloacibacterium normanense, Cloacibacterium normanense, Collinsella aerofaciens, Comamonas denitrificans, Comamonas terrigena, Corynebacterium accolens, Corynebacterium afermentans subsp. lipophilum, Corynebacterium ammoniagenes, Corynebacterium amycolatum, Corynebacterium aurimucosum, Corynebacterium aurimucosum, Corynebacterium coyleae, Corynebacterium durum, Corynebacterium freiburgense, Corynebacterium glaucum, Corynebacterium glyciniphilum, Corynebacterium imitans, Corynebacterium jeikeium, Corynebacterium jeikeium, Corynebacterium kroppenstedtii, Corynebacterium lipophiloflavum, Corynebacterium massiliense, Corynebacterium mastitidis, Corynebacterium matruchotii, Corynebacterium minutissimum, Corynebacterium mucifaciens, Corynebacterium mustelae, Corynebacterium mycetoides, Corynebacterium pyruviciproducens, Corynebacterium simulans, Corynebacterium singulare, Corynebacterium sputi, Corynebacterium suicordis, Corynebacterium tuberculostearicum, Corynebacterium tuberculostearicum, Corynebacterium ureicelerivorans, Corynebacterium variabile, Couchioplanes caeruleus subsp. caeruleus, Cupriavidus metallidurans, Curtobacterium herbarum, Dechloromonas agitata, Deinococcus actinosclerus, Deinococcus antarcticus, Deinococcus caeni, Deinococcus ficus, Deinococcus geothermalis, Deinococcus radiodurans, Deinococcus wulumuqiensis, Deinococcus xinjiangensis, Dermabacter hominis, Dermabacter vaginalis, Dermacoccus nishinomiyaensis, Desemzia incerta, Desertibacter roseus, Dialister invisus, Dialister microaerophilus, Dialister propionicifaciens, Dietzia aurantiaca, Dietzia cercidiphylli, Dietzia timorensis, Dietzia timorensis, Dokdonella koreensis, Dokdonella koreensis, Dolosigranulum pigrum, Eikenella corrodens, Elizabethkingia miricola, Elstera litoralis, Empedobacter brevis, Enhydrobacter aerosaccus, Enterobacter xiangfangensis, Enterococcus aquimarinus, Enterococcus faecalis, Enterococcus olivae, Erwinia rhapontici, Eubacterium eligens, Eubacterium infirmum, Eubacterium rectale, Eubacterium saphenum, Eubacterium sulci, Exiguobacterium mexicanum, Facklamia tabacinasalis, Falsirhodobacter halotolerans, Finegoldia magna, Flavobacterium cutihirudinis, Flavobacterium lindanitolerans, Flavobacterium resistens, Friedmanniella capsulata, Fusobacterium nucleatum subsp. polymorphum, Gemella haemolysans, Gemella morbillorum, Gemella palaticanis, Gemella sanguinis, Gemmobacter aquaticus, Gemmobacter caeni, Gordonia jinhuaensis, Gordonia kroppenstedtii, Gordonia polyisoprenivorans, Gordonia polyisoprenivorans, Granulicatella adiacens, Granulicatella elegans, Haemophilus parainfluenzae, Haemophilus sputorum, Halomonas suffidaeris, Herpetosiphon aurantiacus, Hydrocarboniphaga effusa, Idiomarina marls, Janibacter anophelis, Janibacter hoylei, Janibacter indicus, Janibacter limosus, Janibacter melonis, Jeotgalicoccus halophilus, Jonquetella anthropi, Kaistia geumhonensis, Kingella denitrificans, Kingella oralis, Klebsiella oxytoca, Knoellia aerolata, Knoellia locipacati, Kocuria atrinae, Kocuria camiphila, Kocuria kristinae, Kocuria palustris, Kocuria turfanensis, Lachnoanaerobaculum saburreum, Lachnoanaerobaculum saburreum, Lactobacillus crispatus, Lactobacillus iners, Lactococcus lactis subsp. lactis, Lactococcus lactis subsp. lactis, Lactococcus piscium, Lapillicoccus jejuensis, Lautropia mirabilis, Legionella beliardensis, Leptotrichia buccalis, Leptotrichia goodfellowii, Leptotrichia hofstadii, Leptotrichia hongkongensis, Leptotrichia shahii, Leptotrichia trevisanii, Leptotrichia wadei, Luteimonas terricola, Lysinibacillus fusiformis, Lysobacter spongiicola, Lysobacter xinjiangensis, Macrococcus caseolyticus, Marmoricola pocheonensis, Marmoricola scoriae, Massilia alkalitolerans, Massilia alkalitolerans, Massilia aurea, Massilia plicata, Massilia timonae, Megamonas rupellensis, Meiothermus silvanus, Methylobacterium dankookense, Methylobacterium goesingense, Methylobacterium goesingense, Methylobacterium isbiliense, Methylobacterium jeotgali, Methylobacterium oxalidis, Methylobacterium platani, Methylobacterium pseudosasicola, Methyloversatilis universalis, Microbacterium foliorum, Microbacterium hydrothermale, Microbacterium hydrothermale, Microbacterium lacticum, Microbacterium lacticum, Microbacterium laevaniformans, Microbacterium paludicola, Microbacterium petrolearium, Microbacterium phyllosphaerae, Microbacterium resistens, Micrococcus antarcticus, Micrococcus cohnii, Micrococcus flavus, Micrococcus lylae, Micrococcus terreus, Microlunatus aurantiacus, Micropruina glycogenica, Microvirga aerilata, Microvirga aerilata, Microvirga subterranea, Microvirga vignae, Microvirga zambiensis, Microvirgula aerodenitrificans, Mogibacterium timidum, Moraxella atlantae, Moraxella catarrhalis, Morganella morganii subsp. morganii, Morganella psychrotolerans, Murdochiella asaccharolytica, Mycobacterium asiaticum, Mycobacterium chubuense, Mycobacterium crocinum, Mycobacterium gadium, Mycobacterium holsaticum, Mycobacterium iranicum, Mycobacterium longobardum, Mycobacterium neoaurum, Mycobacterium neoaurum, Mycobacterium obuense, Negativicoccus succinicivorans, Neisseria bacilliformis, Neisseria oralis, Neisseria sicca, Neisseria subflava, Nesterenkonia lacusekhoensis, Nesterenkonia rhizosphaerae, Nevskia persephonica, Nevskia ramosa, Niabella yanshanensis, Niveibacterium umoris, Nocardia niwae, Nocardia thailandica, Nocardioides agariphilus, Nocardioides dilutus, Nocardioides ganghwensis, Nocardioides hwasunensis, Nocardioides nanhaiensis, Nocardioides sediminis, Nosocomiicoccus ampullae, Noviherbaspirillum malthae, Novosphingobium lindaniclasticum, *Novosphingobium rosa, Ochrobactrum rhizosphaerae, Olsenella uli, Ornithinimicrobium murale, Ornithinimicrobium tianjinense, Oryzobacterterrae, Ottowia beijingensis, Paenalcaligenes suwonensis, Paenibacillus agaridevorans, Paenibacillus phoenicis, Paenibacillus xylanexedens, Paludibacterium yongneupense, Pantoea cypripedii, Parabacteroides distasonis, Paraburkholderia andropogonis, Paracoccus alcaliphilus, Paracoccus angustae, Paracoccus kocurii, Paracoccus laeviglucosivorans, Paracoccus sediminis, Paracoccus sphaerophysae, Paracoccus yeei, Parvimonas micra, Parviterribacter multiflagellatus, Patulibacter ginsengiterrae, Pedobacter aquatilis, Pedobacter ginsengisoli, Pedobacter xixiisoli, Peptococcus niger, Peptoniphilus coxii, Peptoniphilus gorbachii, Peptoniphilus harei, Peptoniphilus koenoeneniae, Peptoniphilus lacrimalis, Peptostreptococcus anaerobius, Peptostreptococcus stomatis, Phascolarctobacterium faecium, Phenylobacterium haematophilum, Phenylobacterium kunshanense, Pluralibacter gergoviae, Polymorphobacter multimanifer, Porphyromonas bennonis, Porphyromonas endodontalis, Porphyromonas gingivalis, Porphyromonas gingivicanis, Porphyromonas pasteri, Porphyromonas pogonae, Porphyromonas somerae, Povalibacter uvarum, Prevotella aurantiaca, Prevotella baroniae, Prevotella bivia, Prevotella buccae, Prevotella buccalis, Prevotella copri, Prevotella corporis, Prevotella denticola, Prevotella enoeca, Prevotella histicola, Prevotella intermedia, Prevotella jejuni, Prevotella jejuni, Prevotella maculosa, Prevotella melaninogenica, Prevotella melaninogenica, Prevotella micans, Prevotella multiformis, Prevotella nanceiensis, Prevotella nigrescens, Prevotella oris, Prevotella oulorum, Prevotella pallens, Prevotella pleuritidis, Prevotella saccharolytica, Prevotella salivae, Prevotella shahii, Prevotella timonensis, Prevotella veroralis, Propionibacterium acidifaciens, Propionibacterium acnes* subsp. *acnes, Propionibacterium acnes* subsp. *acnes, Propionibacterium acnes* subsp. *elongatum, Propionibacterium granulosum, Propionimicrobium lymphophilum, Propionispira arcuata, Pseudokineococcus lusitanus, Pseudomonas aeruginosa, Pseudomonas chengduensis, Pseudonocardia benzenivorans, Pseudorhodoplanes sinuspersici, Psychrobacter sanguinis, Ramlibacter ginsenosidimutans, Rheinheimera aquimaris, Rhizobium alvei, Rhizobium daejeonense, Rhizobium larrymoorei, Rhizobium rhizoryzae, Rhizobium soli, Rhizobium taibaishanense, Rhizobium vignae, Rhodanobacter glycinis, Rhodobacter veldkampii, Rhodococcus enclensis, Rhodococcus fascians, Rhodococcus fascians, Rhodovarius lipocyclicus, Rivicola pingtungensis, Roseburia inulinivorans, Rosenbergiella nectarea, Roseomonas aerilata, Roseomonas aquatica, Roseomonas mucosa, Roseomonas rosea, Roseomonas vinacea, Rothia aeria, Rothia amarae, Rothia dentocariosa, Rothia endophytica, Rothia mucilaginosa, Rothia nasimurium, Rubellimicrobium mesophilum, Rubellimicrobium roseum, Rubrobacter bracarensis, Rudaea cellulosilytica, Ruminococcus gnavus, Runella zeae, Saccharopolyspora rectivirgula, Salinicoccus qingdaonensis, Scardovia wiggsiae, Sediminibacterium ginsengisoli, Selenomonas artemidis, Selenomonas infelix, Selenomonas noxia, Selenomonas sputigena, Shewanella aestuarii, Shuttleworthia satelles, Simonsiella muelleri, Skermanella aerolata, Skermanella stibiiresistens, Slackia exigua, Smaragdicoccus niigatensis, Sneathia sanguinegens, Solirubrobacter soli, Sphingobacterium caeni, Sphingobacterium daejeonense, Sphingobacterium hotanense, Sphingobacterium kyonggiense, Sphingobacterium multivorum, Sphingobacterium nematocida, Sphingobacterium spiritivorum, Sphingobium amiense, Sphingobium indicum, Sphingobium lactosutens, Sphingobium subterraneum, Sphingomonas abaci, Sphingomonas aestuarii, Sphingomonas canadensis, Sphingomonas daechungensis, Sphingomonas dokdonensis, Sphingomonas echinoides, Sphingomonas fonticola, Sphingomonas fonticola, Sphingomonas formosensis, Sphingomonas gei, Sphingomonas hankookensis, Sphingomonas hankookensis, Sphingomonas koreensis, Sphingomonas kyeonggiensis, Sphingomonas laterariae, Sphingomonas mucosissima, Sphingomonas oligophenolica, Sphingomonas pseudosanguinis, Sphingomonas sediminicola, Sphingomonas yantingensis, Sphingomonas yunnanensis, Sphingopyxis indica, Spirosoma rigui, Sporacetigenium mesophilum, Sporocytophaga myxococcoides, Staphylococcus auricularis, Staphylococcus epidermidis, Staphylococcus epidermidis, Staphylococcus hominis* subsp. *novobiosepticus, Staphylococcus lugdunensis, Staphylococcus pettenkoferi, Stenotrophomonas koreensis, Stenotrophomonas rhizophila, Stenotrophomonas rhizophila, Streptococcus agalactiae, Streptococcus canis, Streptococcus cristatus, Streptococcus gordonii, Streptococcus infantis, Streptococcus intermedius, Streptococcus mutans, Streptococcus oligofermentans, Streptococcus oralis, Streptococcus sanguinis, Streptomyces iconiensis, Streptomyces yanglinensis, Tabrizicola aquatica, Tahibacter caeni, Tannerella forsythia, Tepidicella xavieri, Tepidimonas fonticaldi, Terracoccus luteus, Tessaracoccus flavescens, Thermus thermophilus, Tianweitania sediminis, Tianweitania sediminis, Treponema amylovorum, Treponema denticola, Treponema lecithinolyticum, Treponema medium, Turicella otitidis, Turicibacter sanguinis, Undibacterium oligocarboniphilum, Undibacterium squillarum, Vagococcus salmoninarum, Varibaculum cambriense, Vibrio metschnikovii, Xanthobacter tagetidis, Xenophilus aerolatus, Xenophilus arseniciresistens, Yimella lutea, Zimmermannella alba, Zimmermannella bifida* and/or *Zoogloea caeni.*

In other embodiments, the targeted bacteria cells are those commonly found in the vaginal microbiota and are, without limitation, *Acinetobacter antiviralis, Acinetobacter baumannii, Acinetobacter calcoaceticus, Acinetobacter johnsonii, Actinobaculum massiliense, Actinobaculum schaalii, Actinomyces europaeus, Actinomyces graevenitzii, Actinomyces israelii, Actinomyces meyeri, Actinomyces naeslundii, Actinomyces neuii, Actinomyces odontolyticus, Actinomyces turicensis, Actinomyces urogenitalis, Actinomyces viscosus, Aerococcus christensenii, Aerococcus urinae, Aerococcus viridans, Aeromonas encheleia, Aeromonas salmonicida, Afipia massiliensis, Agrobacterium tumefaciens, Algoriphagus aquatilis, Allivibrio wodanis, Alistipes finegoldii, Alloiococcus otitis, Alloprevotella tannerae, Alloscardovia omnicolens, Alteretythrobacter epoxidivorans, Ammoniphilus oxalaticus, Amnibacterium kyonggiense, Anaerococcus hydrogenalis, Anaerococcus lactolyticus, Anaerococcus murdochii, Anaerococcus obesiensis, Anaerococcus prevotii, Anaerococcus tetradius, Anaerococcus vaginalis, Anaeroglobus geminatus, Anoxybacillus pushchinoensis, Aquabacterium parvum, Arcanobacterium phocae, Arthrobacter aurescens, Asticcacaulis excentricus, Atopobium minutum, Atopobium parvulum, Atopobium rimae, Atopobium vaginae, Avibacterium gallinarum, Bacillus acidicola, Bacillus atrophaeus, Bacillus cereus, Bacillus cibi, Bacillus coahuilensis, Bacillus gaemokensis, Bacillus methanolicus, Bacillus oleronius, Bacillus pumilus, Bacillus shackletonii, Bacillus sporothermodurans, Bacillus subtilis, Bacillus wakoensis, Bacillus weihenstephanensis, Bacteroides barnesiae, Bacteroides coagulans, Bacteroides dorei, Bacteroides faecis, Bacteroides forsythus, Bacteroides fragilis, Bacteroides nordii, Bacteroides ovatus, Bacteroides salyer-* siae, Bacteroides stercoris, Bacteroides uniformis, Bacteroides vulgatus, Bacteroides xylanisolvens, Bacteroides zoogleoformans, Bamesiella viscericola, Bhargavaea cecembensis, Bifidobacterium adolescentis, Bifidobacterium bifidum, Bifidobacterium breve, Bifidobacterium dentium, Bifidobacterium logum subsp. infantis, Bifidobacterium longum, Bifidobacterium pseudocatenulatum, Bifidobacterium scardovii, Bilophila wadsworthia, Blautia hydrogenotrophica, Blautia obeum, Blautia producta, Brachybacterium faecium, Bradyrhizobium japonicum, Brevibacterium mcbrellneri, Brevibacterium otitidis, Brevibacterium paucivorans, Bulleidia extructa, Burkholderia fungorum, Burkholderia phenoliruptix, Caldicellulosiruptor saccharolyticus, Caldimonas taiwanensis, Campylobacter gracilis, Campylobacter hominis, Campylobacter sputorum, Campylobacter ureolyticus, Capnocytophaga ochracea, Cardiobacterium hominis, Catonella morbi, Chlamydia trachomatis, Chlamydophila abortus, Chondromyces robustus, Chryseobacterium aquaticum, Citrobacter youngae, Cloacibacterium normanense, Clostridium cavendishii, Clostridium colicanis, Clostridium jejuense, Clostridium perfringens, Clostridium ramosum, Clostridium sordellii, Clostridium viride, Comamonas terrigena, Corynebacterium accolens, Corynebacterium appendicis, Corynebacterium coyleae, Corynebacterium glucuronolyticum, Corynebacterium glutamicum, Corynebacterium jeikeium, Corynebacterium kroppenstedtii, Corynebacterium lipophiloflavum, Corynebacterium minutissimum, Corynebacterium mucifaciens, Corynebacterium nuruki, Corynebacterium pseudo genitalium, Corynebacterium pyruviciproducens, Corynebacterium singulare, Corynebacterium striatum, Corynebacterium tube rculostearicum, Corynebacterium xerosis, Cryobacterium psychrophilum, Curtobacterium flaccumfaciens, Cutibacterium acnes, Cutibacterium avidum, Cytophaga xylanolytica, Deinococcus radiophilus, Delftia tsuruhatensis, Desulfovibrio desulfuricans, Dialister invisus, Dialister micraerophilus, Dialister pneumosintes, Dialister propionicifaciens, Dickeya chrysanthemi, Dorea longicatena, Eggerthella lenta, Eggerthia catenaformis, Eikenella corrodens, Enhydrobacter aerosaccus, Enterobacter asburiae, Enterobacter cloacae, Enterococcus avium, Enterococcus durans, Enterococcus faecalis, Enterococcus faecium, Enterococcus hirae, Erwinia persicina, Erwinia rhapontici, Erwinia toletana, Escherichia coli, Escherichia fergusonii, Eubacterium brachy, Eubacterium eligens, Eubacterium nodatum, Eubacterium rectale, Eubacterium saphenum, Eubacterium siraeum, Eubacterium sulci, Eubacterium yurii, Exiguobacterium acetylicum, Facklamia ignava, Faecalibacterium prausnitzii, Filifactor alocis, Finegoldia magna, Fusobacterium gonidiaformans, Fusobacterium nucleatum, Fusobacterium periodonticum, Gardnerella vaginalis, Gemella asaccharolytica, Gemella bergeri, Gemella haemolysans, Gemella sanguinis, Geobacillus stearothermophilus, Geobacillus thermocatenulatus, Geobacillus thermoglucosidasius, Geobacter grbiciae, Granulicatella elegans, Haemophilus ducreyi, Haemophilus haemolyticus, Haemophilus parahaemolyticus, Haemophilus parainfluenzae, Hafnia alvei, Halomonas meridiana, Halomonas phoceae, Halomonas venusta, Herbaspirillum seropedicae, Janthinobacterium lividum, Jonquetella anthropi, Klebsiella granulomatis, Klebsiella oxytoca, Klebsiella pneumoniae, Lactobacillus acidophilus, Lactobacillus amylovorus, Lactobacillus brevis, Lactobacillus coleohominis, Lactobacillus crispatus, Lactobacillus curvatus, Lactobacillus delbrueckii, Lactobacillus fermentum, Lactobacillus gasseri, Lactobacillus helveticus, Lactobacillus iners, Lactobacillus jensenii, Lactobacillus johnsonii, Lactobacillus kalixensis, Lactobacillus kefiranofaciens, Lactobacillus kimchicus, Lactobacillus kitasatonis, Lactobacillus mucosae, Lactobacillus panis, Lactobacillus paracasei, Lactobacillus plantarum, Lactobacillus pontis, Lactobacillus reuteri, Lactobacillus rhamnosus, Lactobacillus salivarius, Lactobacillus ultunensis, Lactobacillus vaginalis, Lactococcus lactis, Leptotrichia buccalis, Leuconostoc carnosum, Leuconostoc citreum, Leuconostoc garlicum, Leuconostoc lactis, Leuconostoc mesenteroides, Lysinimonas kribbensis, Mageeibacillus indolicus, Maribacter orientalis, Marinomonas protea, Marinospirillum insulare, Massilia timonae, Megasphaera elsdenii, Megasphaera micronuciformis, Mesorhizobium amorphae, Methylobacterium radiotolerans, Methylotenera versatilis, Microbacterium halophilum, Micrococcus luteus, Microterricola viridarii, Mobiluncus curtisii, Mobiluncus mulieris, Mogibacterium timidum, Moorella glycerini, Moraxella osloensis, Morganella morganii, Moryella indoligenes, Murdochiella asaccharolytica, Mycoplasma alvi, Mycoplasma genitalium, Mycoplasma hominis, Mycoplasma muris, Mycoplasma salivarium, Negativicoccus succinicivorans, Neisseria flava, Neisseria gonorrhoeae, Neisseria mucosa, Neisseria subflava, Nevskia ramosa, Nevskia soli, Nitriliruptor alkaliphilus, Odoribacter splanchnicus, Oligella urethralis, Olsenella uli, Paenibacillus amylolyticus, Paenibacillus humicus, Paenibacillus pabuli, Paenibacillus pasadenensis, Paenibacillus pini, Paenibacillus validus, Pantoea agglomerans, Parabacteroides merdae, Paraburkholderia caryophylli, Paracoccus yeei, Parastreptomyces abscessus, Parvimonas micra, Pectobacterium betavasculorum, Pectobacterium carotovorum, Pediococcus acidilactici, Pediococcus ethanolidurans, Pedobacter alluvionis, Pedobacter wanjuense, Pelomonas aquatica, Peptococcus niger, Peptoniphilus asaccharolyticus, Peptoniphilus gorbachii, Peptoniphilus harei, Peptoniphilus indolicus, Peptoniphilus lacrimalis, Peptoniphilus massiliensis, Peptostreptococcus anaerobius, Peptostreptococcus massiliae, Peptostreptococcus stomatis, Photobacterium angustum, Photobacterium frigidiphilum, Photobacterium phosphoreum, Porphyromonas asaccharolytica, Porphyromonas bennonis, Porphyromonas catoniae, Porphyromonas endodontalis, Porphyromonas gingivalis, Porphyromonas somerae, Porphyromonas uenonis, Prevotella amnii, Prevotella baroniae, Prevotella bergensis, Prevotella bivia, Prevotella buccae, Prevotella buccalis, Prevotella colorans, Prevotella copri, Prevotella corporis, Prevotella dentalis, Prevotella denticola, Prevotella disiens, Prevotella intermedia, Prevotella loescheii, Prevotella marshii, Prevotella melaninogenica, Prevotella micans, Prevotella nigrescens, Prevotella oris, Prevotella pleuritidis, Prevotella ruminicola, Prevotella shahii, Prevotella stercorea, Prevotella timonensis, Prevotella veroralis, Propionimicrobium lymphophilum, Proteus mirabilis, Pseudomonas abietaniphila, Pseudomonas aeruginosa, Pseudomonas amygdali, Pseudomonas azotoformans, Pseudomonas chlororaphis, Pseudomonas cuatrocienegasensis, Pseudomonas fluorescens, Pseudomonas fulva, Pseudomonas lutea, Pseudomonas mucidolens, Pseudomonas oleovorans, Pseudomonas orientalis, Pseudomonas pseudoalcaligenes, Pseudomonas psychrophila, Pseudomonas putida, Pseudomonas synxantha, Pseudomonas syringae, Pseudomonas tolaasii, Pseudopropionibacterium propionicum, Rahnella aquatilis, Ralstonia pickettii, Ralstonia solanacearum, Raoultella planticola, Rhizobacter dauci, Rhizobium etli, Rhodococcus fascians, Rhodopseudomonas palustris, Roseburia intestinalis, Roseburia inulinivorans, Rothia mucilaginosa, Ruminococcus bromii, Ruminococcus gnavus, Ruminococcus torques, Sanguibacter keddieii, Sedi-

*minibacterium salmoneum, Selenomonas bovis, Serratia fonticola, Serratia liquefaciens, Serratia marcescens, Shewanella algae, Shewanella amazonensis, Shigella boydii, Shigella sonnei, Slackia exigua, Sneathia amnii, Sneathia sanguinegens, Solobacterium moorei, Sorangium cellulosum, Sphingobium amiense, Sphingobium japonicum, Sphingobium yanoikuyae, Sphingomonas wittichii, Sporosarcina aquimarina, Staphylococcus aureus, Staphylococcus auricularis, Staphylococcus capitis, Staphylococcus epidermidis, Staphylococcus haemolyticus, Staphylococcus hominis, Staphylococcus lugdunensis, Staphylococcus saprophyticus, Staphylococcus schleiferi, Staphylococcus simiae, Staphylococcus simulans, Staphylococcus warneri, Stenotrophomonas maltophilia, Stenoxybacter acetivorans, Streptococcus agalactiae, Streptococcus anginosus, Streptococcus australis, Streptococcus equinus, Streptococcus gallolyticus, Streptococcus infantis, Streptococcus intermedius, Streptococcus lutetiensis, Streptococcus marimammalium, Streptococcus mitis, Streptococcus mutans, Streptococcus oralis, Streptococcus parasanguinis, Streptococcus phocae, Streptococcus pseudo pneumoniae, Streptococcus salivarius, Streptococcus sanguinis, Streptococcus thermophilus, Sutterella wadsworthensis, Tannerella forsythia, Terrahaemophilus aromaticivorans, Treponema denticola, Treponema maltophilum, Treponema parvum, Treponema vincentii, Trueperella bernardiae, Turicella otitidis, Ureaplasma parvum, Ureaplasma urealyticum, Varibaculum cambriense, Variovorax paradoxus, Veillonella atypica, Veillonella dispar, Veillonella montpellierensis, Veillonella parvula, Virgibacillus proomii, Viridibacillus arenosi, Viridibacillus arvi, Weissella cibaria, Weissella soli, Xanthomonas campestris, Xanthomonas vesicatoria, Zobellia laminariae* and/or *Zoogloea ramigera.*

In one embodiment, the targeted bacteria are *Escherichia coli.*

In one embodiment, the targeted bacteria are *Cutibacterium acnes* more specifically the acne related *Cutibacterium acnes* from the phylogroup IA1 or RT4, RT5, RT8, RT9, RT10 or Clonal Complex (CC) CC1, CC3, CC4, more specifically the ST1, ST3, ST4.

Bacteriophages used for preparing bacterial virus particles such as packaged phagemids, may target (e.g., specifically target) a bacterial cell from any one or more of the disclosed genus and/or species of bacteria to specifically deliver the payload.

In one embodiment, the targeted bacteria are pathogenic bacteria. The targeted bacteria can be virulent bacteria.

The targeted bacteria can be antibacterial resistance bacteria, preferably selected from the group consisting of extended-spectrum beta-lactamase-producing (ESBL) *Escherichia coli*, ESBL *Klebsiella pneumoniae*, vancomycin-resistant *Enterococcus* (VRE), methicillin-resistant *Staphylococcus aureus* (MRSA), multidrug-resistant (MDR) *Acinetobacter baumannii*, MDR *Enterobacter* spp., and a combination thereof. Preferably, the targeted bacteria can be selected from the group consisting of extended-spectrum beta-lactamase-producing (ESBL) *Escherichia coli* strains.

Alternatively, the targeted bacterium can be a bacterium of the microbiome of a given species, preferably a bacterium of the human microbiota.

Bacterial Viruses

The bacterial virus particles are prepared from bacterial virus. The bacterial viruses are chosen in order to be able to introduce the payload into the targeted bacteria.

Bacterial viruses are preferably bacteriophages. Bacteriophages are obligate intracellular parasites that multiply inside bacteria by co-opting some or all of the host biosynthetic machinery. Phage genomes come in a variety of sizes and shapes (e.g., linear or circular). Most phages range in size from 24-200 nm in diameter. Phages contain nucleic acid (i.e., genome) and proteins, and may be enveloped by a lipid membrane. Depending upon the phage, the nucleic acid genome can be either DNA or RNA, and can exist in either circular or linear forms. The size of the phage genome varies depending upon the phage. The simplest phages have genomes that are only a few thousand nucleotides in size, while the more complex phages may contain more than 100,000 nucleotides in their genome, and in rare instances more than 1,000,000. The number and amount of individual types of protein in phage particles will vary depending upon the phage.

Optionally, the bacteriophage is selected from the Order Caudovirales consisting of, based on the taxonomy of Krupovic et al, Arch Virol, 2015:

family Myoviridae (such as, without limitation, genus Cp220virus, Cp8virus, Ea214virus, Felixo1virus, Mooglevirus, Suspvirus, Hp1virus, P2virus, Kayvirus, P100virus, Silviavirus, Spo1virus, Tsarbombavirus, Twortvirus, Cc31virus, Jd18virus, Js98virus, Kp15virus, Moonvirus, Rb49virus, Rb69virus, S16virus, Schizot4virus, Sp18virus, T4virus, Cr3virus, Se1virus, V5virus, Abouovirus, Agatevirus, Agrican357virus, Ap22virus, Arv1virus, B4virus, Bastillevirus, Bc431virus, Bcep78virus, Bcepmuvirus, Biquartavirus, Bxz1virus, Cd119virus, Cp51virus, Cvm10virus, Eah2virus, E1virus, Hapunavirus, Jimmervirus, Kpp10virus, M12virus, Machinavirus, Marthavirus, Msw3virus, Muvirus, Myohalovirus, Nit1 virus, P1virus, Pakpunavirus, Pbunavirus, Phikzvirus, Rheph4virus, Rsl2virus, Rslunavirus, Secunda5virus, Sep1virus, Spn3virus, Svunavirus, Tg1virus, Vhmlvirus and Wphvirus)

family Podoviridae (such as, without limitation, genus Fri1virus, Kp32virus, Kp34virus, Phikmvvirus, Pradovirus, Sp6virus, T7virus, Cp1virus, P68virus, Phi29virus, Nona33virus, Pocjvirus, T12011virus, Bcep22virus, Bpp1virus, Cba41virus, Dfl12virus, Ea92virus, Epsilon15virus, F116virus, G7cvirus, Jwalphavirus, Kf1virus, Kpp25virus, Lit1virus, Luz24virus, Luz7virus, N4virus, Nonanavirus, P22virus, Pagevirus, Phieco32virus, Prtbvirus, Sp58virus, Una961virus and Vp5virus)

family Siphoviridae (such as, without limitation, genus Camvirus, Likavirus, R4virus, Acadianvirus, Coopervirus, Pg1virus, Pipefishvirus, Rosebushvirus, Brujitavirus, Che9cvirus, Hawkeyevirus, Plotvirus, Jerseyvirus, Klgvirus, Sp31virus, Lmd1virus, Una4virus, Bongovirus, Reyvirus, Buttersvirus, Charlievirus, Redivirus, Baxtervirus, Nymphadoravirus, Bignuzvirus, Fishburnevirus, Phayoncevirus, Kp36virus, Rogue1virus, Rtpvirus, T1virus, Tlsvirus, Ab18virus, Amigovirus, Anatolevirus, Andromedavirus, Attisvirus, Barnyardvirus, Bernal13virus, Biseptimavirus, Bronvirus, C2virus, C5virus, Cba181virus, Cbastvirus, Cecivirus, Che8virus, Chivirus, Cjw1virus, Corndogvirus, Cronusvirus, D3112virus, D3virus, Decurrovirus, Demosthenesvirus, Doucettevirus, E125virus, Eiauvirus, Ff47virus, Gaiavirus, Gilesvirus, Gordonvirus, Gordtnkvirus, Harrisonvirus, Hk578virus, Hk97virus, Jenstvirus, Jwxvirus, Kelleziovirus, Korravirus, L5virus, Lambdavirus, Laroyevirus, Liefievirus, Marvinvirus, Mudcatvirus, N15virus, Nonagvirus, Np1virus, Omegavirus, P12002virus, P12024virus, P23virus, P70virus, Pa6virus, Pamx74virus, Patiencevirus, Pbi1virus, Pepy6virus, Pfr1virus, Phic31virus, Phicbkvirus, Phietavirus, Phife1virus, Phijl1virus, Pis4avirus, Psavirus, Psimunavirus, Rdj1virus, Rer2virus, Sap6virus, Send513virus, Septima3virus, Seuratvirus, Sextaecvirus, Sfi11virus, Sfi21dt1virus, Sitaravirus, Sk1virus, Slashvirus, Smoothievirus, Soupsvirus, Spbetavirus, Ssp2virus, T5virus, Tankvirus, Tin2virus, Titanvirus, Tm4virus, Tp21virus, Tp84virus, Triavirus, Trigintaduovirus, Vegasvirus, Vendettavirus, Wbetavirus, Wildcatvirus, Wizardvirus, Woesvirus, Xp10virus, Ydn12virus and Yuavirus)

family Ackermannviridae (such as, without limitation, genus Ag3virus, Limestonevirus, Cba120virus and Vi1virus)

Optionally, the bacteriophage is not part of the Order Caudovirales but from families with Unassigned order such as, without limitation, family Tectiviridae (such as genus Alphatectivirus, Betatectivirus), family Corticoviridae (such as genus Corticovirus), family Inoviridae (such as genus Fibrovirus, Habenivirus, Inovirus, Lineavirus, Plectrovirus, Saetivirus, Vespertiliovirus), family Cystoviridae (such as genus Cystovirus), family Leviviridae (such as genus Allolevivirus, Levivirus), family Microviridae (such as genus Alpha3microvirus, G4microvirus, Phix174microvirus, Bdellomicrovirus, Chlamydiamicrovirus, Spiromicrovirus) and family Plasmaviridae (such as genus Plasmavirus).

Optionally, the bacteriophage is targeting Archea not part of the Order Caudovirales but from families with Unassigned order such as, without limitation, Ampullaviridae, FuselloViridae, Globuloviridae, Guttaviridae, Lipothrixviridae, Pleolipoviridae, Rudiviridae, Salterprovirus and Bicaudaviridae.

A non-exhaustive listing of bacterial genera and their known host-specific bacteria viruses is presented in the following paragraphs. Synonyms and spelling variants are indicated in parentheses. Homonyms are repeated as often as they occur (e.g., D, D, d). Unnamed phages are indicated by "NN" beside their genus and their numbers are given in parentheses.

Bacteria of the genus *Actinomyces* can be infected by the following phages: Av-I, Av-2, Av-3, BF307, CTI, CT2, CT3, CT4, CT6, CT7, CT8 and 1281.

Bacteria of the genus *Aeromonas* can be infected by the following phages: AA-I, Aeh2, N, PMI, TP446, 3, 4, 11, 13, 29, 31, 32, 37, 43, 43-10T, 51, 54, 55R.1, 56, 56RR2, 57, 58, 59.1, 60, 63, Aehl, F, PM2, 1, 25, 31, 40RR2.8t, (syn=44R), (syn=44RR2.8t), 65, PM3, PM4, PM5 and PM6.

Bacteria of the genus *Bacillus* can be infected by the following phages: A, aizI, AI-K-I, B, BCJAI, BCI, BC2, BLLI, BLI, BP142, BSLI, BSL2, BSI, BS3, BS8, BS15, BS18, BS22, BS26, BS28, BS31, BS104, BS105, BS106, BTB, B1715V1, C, CK-I, ColI, CorI, CP-53, CS-I, CSi, D, D, D, D5, entl, FP8, FP9, FSi, FS2, FS3, FS5, FS8, FS9, G, GH8, GT8, GV-I, GV-2, GT-4, g3, gl2, gl3, gl4, gl6, gl7, g21, g23, g24, g29, H2, kenl, KK-88, Kuml, Kyul, J7W-1, LP52, (syn=LP-52), L7, Mexl, MJ-I, mor2, MP-7, MPIO, MP12, MP14, MP15, Neol, N° 2, N5, N6P, PBCI, PBLA, PBPI, P2, S-a, SF2, SF6, ShaI, SilI, SP02, (syn=φSPP1), SPβ, STI, STi, SU-11, t, TbI, Tb2, Tb5, TbIO, Tb26, Tb51, Tb53, Tb55, Tb77, Tb97, Tb99, Tb560, Tb595, Td8, Td6, Tdl5, TgI, Tg4, Tg6, Tg7, Tg9, TgII, TgII, Tgl3, Tgl5, Tg21, TinI, Tin7, Tin8, Tinl3, Tm3, TocI, TogI, tolI, TP-1, TP-10vir, TP-15c, TP-16c, TP-17c, TP-19, TP35, TP51, TP-84, Tt4, Tt6, type A, type B, type C, type D, type E, Tφ3, VA-9, W, wx23, wx26, YunI, α, γ, ρ I, φmed-2, φT, φμ-4, φ3T, φ75, φIO5, (syn=φIO5), IA, IB, 1-97A, 1-97B, 2, 2, 3, 3, 3, 5, 12, 14, 20, 30, 35, 36, 37, 38, 41C, 51, 63, 64, 138D, I, II, IV, NN-*Bacillus* (13), aleI, ARI, AR2, AR3, AR7, AR9, Bace-11, (syn=11), Bastille, BLI, BL2, BL3, BL4, BL5, BL6, BL8, BL9, BP124, BS28, BS80, Ch, CP-51, CP-54, D-5, dart, dent, DP-7, entl, FoSi, FoS2, FS4, FS6, FS7, G, gall, gamma, GEI, GF-2, GSi, GT-I, GT-2, GT-3, GT-4, GT-5, GT-6, GT-7, GV-6, gl5, 19, 110, ISi, K, MP9, MP13, MP21, MP23, MP24, MP28, MP29, MP30, MP32, MP34, MP36, MP37, MP39, MP40, MP41, MP43, MP44, MP45, MP47, MP50, NLP-I, No. I, N17, N19, PBSI, PKI, PMBI, PMB12, PMJI, S, SPOI, SP3, SP5, SP6, SP7, SP8, SP9, SPIO, SP-15, SP50, (syn=SP-50), SP82, SST, subI, SW, Tg8, Tgl2, Tgl3, Tgl4, thuI, thuΛ, thuS, Tin4, Tin23, TP-13, TP33, TP50, TSP-I, type V, type VI, V, Vx, β22, φe, φNR2, φ25, φ63, 1, 1, 2, 2C, 3NT, 4, 5, 6, 7, 8, 9, 10, 12, 12, 17, 18, 19, 21, 138, III, 4 (*B. megateriwn*), 4 (*B. sphaericus*), AR13, BPP-IO, BS32, BS107, BI, B2, GA-1, GP-10, GV-3, GV-5, g8, MP20, MP27, MP49, Nf, PPS, PP6, SF5, Tgl8, TP-I, Versailles, φl5, φ29, 1-97, 837/IV, mï-*Bacillus* (1), BatIO, BSLIO, BSLI 1, BS6, BSI I, BS16, BS23, BSIOI, BS102, gl8, morI, PBLI, SN45, thu2, thu3, TmI, Tm2, TP-20, TP21, TP52, type F, type G, type IV, HN-BacMus (3), BLE, (syn=θc), BS2, BS4, BS5, BS7, BIO, B12, BS20, BS21, F, MJ-4, PBA12, AP50, AP50-04, AP50-11, AP50-23, AP50-26, AP50-27 and Bam35. The following *Bacillus*-specific phages are defective: DLP10716, DLP-11946, DPBS, DPB12, DPB21, DPB22, DPB23, GA-2, M, No. IM, PBLB, PBSH, PBSV, PBSW, PBSX, PBSY, PBSZ, phi, SPa, type 1 and μ.

Bacteria of the genus *Bacteroides* can be infected by the following phages: crAss-phage, ad I2, Baf-44, Baf-48B, Baf-64, Bf-I, Bf-52, B40-8, FI, βI, φAI, φBrOI, φBrO2, 11, 67.1, 67.3, 68.1, mt-*Bacteroides* (3), Bf42, Bf71, HN-Bdellovibrio (1) and BF-41.

Bacteria of the genus *Bordetella* can be infected by the following phages: 134 and NN-*Bordetella* (3).

Bacteria of the genus *Borrellia* can be infected by the following phages: NN-*Borrelia* (1) and NN-*Borrelia* (2).

Bacteria of the genus *Brucella* can be infected by the following phages: A422, Bk, (syn=Berkeley), BM29, FOi, (syn=FOI), (syn=FQI), D, FP2, (syn=FP2), (syn=FD2), Fz, (syn=Fz75/13), (syn=Firenze 75/13), (syn=Fi), Fi, (syn=FI), Fim, (syn=FIm), (syn=Fim), FiU, (syn=FIU), (syn=FiU), F2, (syn=F2), F3, (syn=F3), F4, (syn=F4), F5, (syn=F5), F6, F7, (syn=F7), F25, (syn=F25), (syn=£25), F25U, (syn=F25u), (syn=F25U), (syn=F25V), F44, (syn-F44), F45, (syn=F45), F48, (syn=F48), I, Im, M, MC/75, M51, (syn=M85), P, (syn=D), S708, R, Tb, (syn=TB), (syn=Tbilisi), W, (syn=Wb), (syn=Weybridge), X, 3, 6, 7, 10/1, (syn=10), (syn=F8), (syn=F8), 12m, 24/11, (syn=24), (syn=F9), (syn=F9), 45/111, (syn=45), 75, 84, 212/XV, (syn=212), (syn=Fi0), (syn=FIO), 371/XXIX, (syn=371), (syn=Fn), (syn=FI I) and 513.

Bacteria of the genus *Burkholderia* can be infected by the following phages: CP75, NN-*Burkholderia* (1) and 42.

Bacteria of the genus *Campylobacter* can be infected by the following phages: C type, NTCC12669, NTCC12670, NTCC12671, NTCC12672, NTCC12673, NTCC12674, NTCC12675, NTCC12676, NTCC12677, NTCC12678, NTCC12679, NTCC12680, NTCC12681, NTCC12682, NTCC12683, NTCC12684, 32f, 111c, 191, NN-*Campylobacter* (2), Vfi-6, (syn=V19), VfV-3, V2, V3, V8, V16, (syn=Vfi-1), V19, V20(V45), V45, (syn=V-45) and NN-*Campylobacter* (1).

Bacteria of the genus *Chlamydia* can be infected by the following phage: ChpI.

Bacteria of the genus *Clostridium* can be infected by the following phages: CAKI, CA5, Ca7, CEβ, (syn=10), CEγ, CldI, c-n71, c-203 Tox-, DEβ, (syn=ID), (syn=IDt0X+), HM3, KMI, KT, Ms, NAI, (syn=Naltox+), PA135Oe, Pfó, PL73, PL78, PL81, PI, P50, P5771, P19402, ICt0X+, 2Ct0X\ 2D3 (syn=2Dt0X+), 3C, (syn=3Ctox+), 4C, (syn=4Ct0X+), 56, III-I, NN-*Clostridium* (61), NBItOX+, αI, CAI, HMT, HM2, PFI5 P-23, P-46, Q-05, Q-oe, Q-16, Q-21, Q-26, Q-40, Q-46, S111, SA02, WA01, WA03, Wm, W523, 80, C, CA2, CA3, CPTI, CPT4, cI, c4, c5, HM7, H11/A1, H18/Ax, FWS23, Hi58ZA1, K2ZA1, K21ZS23, ML, NA2tOX; Pf2, Pf3, Pf4, S9ZS3, S41ZA1, S44ZS23, α2, 41, 112ZS23, 214/S23, 233/Ai, 234/S23, 235/S23, II-I, II-2, II-3, NN-*Clostridium* (12), CAI, FI, K, S2, 1, 5 and NN-*Clostridium* (8).

Bacteria of the genus *Corynebacterium* can be infected by the following phages: CGKI (defective), A, A2, A3, A101, A128, A133, A137, A139, A155, A182, B, BF, B17, B18, B51, B271, B275, B276, B277, B279, B282, C, capi, CCI, CGI, CG2, CG33, CL31, Cog, (syn=CG5), D, E, F, H, H-I, hqi, hq2, 11ZH33, li/31, J, K, K, (syn=Ktox"), L, L, (syn=Ltox+), M, MC-I, MC-2, MC-3, MC-4, MLMa, N, O, ovi, ov2, ov3, P, P, R, RP6, RS29, S, T, U, UB1, ub2, UH1, UH3, uh3, uh5, uh6, β, (syn=βtox+), βhv64, βvir, γ, (syn=γtoχ-), γI9, δ, (syn=δ'ox+), p, (syn=ptoχ-), φ9, φ984, ω, IA, 1/1180, 2, 2/1180, 5/1180, 5ad/9717, 7/4465, 8/4465, 8ad/10269, 10/9253, 13Z9253, 15/3148, 21/9253, 28, 29, 55, 2747, 2893, 4498 and 5848.

Bacteria of the genus *Enterococcus* are infected by the following phage: DF78, FI, F2, 1, 2, 4, 14, 41, 867, DI, SB24, 2BV, 182, 225, C2, C2F, E3, E62, DS96, H24, M35, P3, P9, SBIOI, S2, 2BII, 5, 182a, 705, 873, 881, 940, 1051, 1057, 21096C, NN-*Enterococcus* (1), PEI, FI, F3, F4, VD13, 1, 200, 235 and 341.

Bacteria of the genus *Erysipelothrix* can be infected by the following phage: NN-Eiysipelothrix (1).

Bacteria of the genus *Escherichia* can be infected by the following phages: BW73, B278, D6, D108, E, El, E24, E41, FI-2, FI-4, FI-5, HI8A, FfI8B, i, MM, Mu, (syn=mu), (syn=MuI), (syn=Mu-I), (syn=MU-I), (syn=MuI), (syn=μ), 025, PhI-5, Pk, PSP3, PI, PID, P2, P4 (defective), SI, Wφ, φK13, φR73 (defective), φI, φ2, φ7, φ92, ψ (defective), 7 A, 8φ, 9φ, 15 (defective), 18, 28-1, 186, 299, HH-*Escherichia* (2), AB48, CM, C4, C16, DD-VI, (syn=Dd-Vi), (syn=DDVI), (syn=DDVi), E4, E7, E28, FII, FI3, H, HI, H3, H8, K3, M, N, ND-2, ND-3, ND4, ND-5, ND6, ND-7, Ox-I (syn=OXI), (syn=HF), Ox-2 (syn=0x2), (syn=0X2), Ox-3, Ox-4, Ox-5, (syn=0X5), Ox-6, (syn=66F), (syn=φ66t), (syn=φ66t-)5 0111, PhI-I, RB42, RB43, RB49, RB69, S, Sal-I, Sal-2, Sal-3, Sal-4, Sal-5, Sal-6, TC23, TC45, TulI*-6, (syn=TulI*), TulP-24, TulI*46, TulP-60, T2, (syn=ganuTia), (syn=γ), (syn=PC), (syn=P.C.), (syn=T-2), (syn=T2), (syn=P4), T4, (syn=T-4), (syn=T4), T6, T35, αI, 1, IA, 3, (syn=Ac3), 3A, 3T+, (syn=3), (syn=MI), 5φ, (syn=φ5), 9266Q, CFO103, HK620, J, K, KIF, m59, no. A, no. E, no. 3, no. 9, N4, sd, (syn=Sd), (syn=SD), (syn=Sa)3 (syn=sd), (syn=SD), (syn=CD), T3, (syn=T-3), (syn=T3), T7, (syn=T-7), (syn=T7), WPK, W31, ΔH, φC3888, φK3, φK7, φK12, φV-1, φ04-CF, φ05, φ06, φ07, φI, φI.2, φ20, φ95, φ263, φIO92, φI, φII, (syn=φW), Ω8, 1, 3, 7, 8, 26, 27, 28-2, 29, 30, 31, 32, 38, 39, 42, 933W, NN-*Escherichia* (1), Esc-7-11, AC30, CVX-5, CI, DDUP, ECI, EC2, E21, E29, FI, F26S, F27S, Hi, HK022, HK97, (syn=φHK97), HK139, HK253, HK256, K7, ND-1, no.D, PA-2, q, S2, TI, (syn=α), (syn=P28), (syn=T-I), (syn=Tx), T3C, T5, (syn=T-5), (syn=T5), UC-I, w, β4, γ2, λ (syn=lambda), (syn=φλ), φD326, φγ, φ06, φ7, φ10, φ80, χ, (syn=χi), (syn=φχ), (syn=φχi), 2, 4, 4A, 6, 8A, 102, 150, 168, 174, 3000, AC6, AC7, AC28, AC43, AC50, AC57, AC81, AC95, HK243, KIO, ZG/3A, 5, 5A, 21EL, H19-J, 933H, O157 typing phages 1 to 16, JES-2013, 121Q, 172-1, 1720a-02, ADB-2, AKFV33, av-05, bVEcoS_AHP42, bV_EcoS_AHP24, bC_EcoS_AHS24, bV_EcoS_AKS96, CBA120.

Bacteria of the genus *Fusobacterium* are infected by the following phage: NN-*Fusobacterium* (2), fv83-554/3, fv88-531/2, 227, fv2377, fv2527 and fv8501.

Bacteria of the genus *Haemophilus* are infected by the following phage: HPI, S2 and N3.

Bacteria of the genus *Helicobacter* are infected by the following phage: HPI and ^^ *Helicobacter* (1).

Bacteria of the genus *Klebsiella* are infected by the following phage: AIO-2, KI4B, KI6B, K19, (syn=K19), KI14, KI15, KI21, KI28, KI29, KI32, KI33, KI35, KI106B, KI171B, KI181B, KI832B, AIO-1, AO-I, AO-2, AO-3, FC3-10, K, KI1, (syn=KII), KI2, (syn=KI2), KI3, (syn=K13), (syn=KI 70/11), KI4, (syn=K14), KI5, (syn=K15), KI6, (syn=K16), KI7, (syn=K17), KI8, (syn=K18), KI19, (syn=K19), KI27, (syn=K127), KI31, (syn=K131), KI35, KI171B, II, VI, IX, CI-I, KI4B, KI8, KI11, KI12, KI13, KI16, KI17, KI18, KI20, KI22, KI23, KI24, KI26, KI30, KI34, KI106B, KIi65B, KI328B, KLXI, K328, P5046, 11, 380, III, IV, VII, VIII, FC3-11, KI2B, (syn=K12B), KI25, (syn=K125), KI42B, (syn=K142), (syn=K142B), KI181B, (syn=KII 81), (syn=K1181B), KI765/!, (syn=KI765/1), KI842B, (syn=KI832B), KI937B, (syn=KI937B), LI, φ28, 7, 231, 483, 490, 632 and 864/100.

Bacteria of the genus *Leptospira* are infected by the following phage: LEI, LE3, LE4 and ~NN-*Leptospira* (1).

Bacteria of the genus *Listeria* are infected by the following phage: A511, 01761, 4211, 4286, (syn=BO54), A005, A006, A020, A500, A502, A511, AI 18, A620, A640, B012, B021, B024, B025, B035, B051, B053, B054, B055, B056, BIOI, BI IO, B545, B604, B653, C707, D441, HSO47, HIOG, H8/73, H19, H21, H43, H46, H107, H108, HI IO, H163/84, H312, H340, H387, H391/73, H684/74, H924A, PSA, U153, φMLUP5, (syn=P35), 00241, 00611, 02971A, 02971C, 5/476, 5/911, 5/939, 5/11302, 5/11605, 5/11704, 184, 575, 633, 699/694, 744, 900, 1090, 1317, 1444, 1652, 1806, 1807, 1921/959, 1921/11367, 1921/11500, 1921/11566, 1921/12460, 1921/12582, 1967, 2389, 2425, 2671, 2685, 3274, 3550, 3551, 3552, 4276, 4277, 4292, 4477, 5337, 5348/11363, 5348/11646, 5348/12430, 5348/12434, 10072, 11355C, 11711A, 12029, 12981, 13441, 90666, 90816, 93253, 907515, 910716 and NN-*Listeria* (15).

Bacteria of the genus *Morganella* are infected by the following phage: 47.

Bacteria of the genus *Mycobacterium* are infected by the following phage: 13, AGI, ALi, ATCC 11759, A2, B.C3, BG2, BKI, BK5, *butyricum*, B-I, B5, B7, B30, B35, Clark, CI, C2, DNAIII, DSP1, D4, D29, GS4E, (syn=GS4E), GS7, (syn=GS-7), (syn=GS7), IPa, lacticola, Legendre, Leo, L5, (syn=φL-5), MC-I, MC-3, MC-4, minetti, MTPHI I, Mx4, MyF3P/59a, phlei, (syn=phlei 1), phlei 4, Polonus II, rabinovitschi, smegmatis, TM4, TM9, TMIO, TM20, Y7, YIO, φ630, IB, IF, IH, 1/1, 67, 106, 1430, BI, (syn=Bol), B24, D, D29, F-K, F-S, HP, Polonus I, Roy, RI, (syn=RI-Myb), (syn=Ri), 11, 31, 40, 50, 103a, 103b, 128, 3111-D, 3215-D and NN-*Mycobacterium* (1).

Bacteria of the genus *Neisseria* are infected by the following phage: Group I, group II and NPI.

Bacteria of the genus *Nocardia* are infected by the following phage: MNP8, NJ-L, NS-8, N5 and TtiN-*Nocardia*.

Bacteria of the genus *Proteus* are infected by the following phage: Pm5, 13vir, 2/44, 4/545, 6/1004, 13/807, 20/826, 57, 67b, 78, 107/69, 121, 9/0, 22/608, 30/680, PmI, Pm3, Pm4, Pm6, Pm7, Pm9, PmIO, PmI I, Pv2, πI, φm, 7/549, 9B/2, 10A/31, 12/55, 14, 15, 16/789, 17/971, 19A/653, 23/532, 25/909, 26/219, 27/953, A2A/909, 33/971, 34/13, 65, 5006M, 7480b, VI, 13/3a, Clichy 12, π2600, φχ7, 1/1004, 5/742, 9, 12, 14, 22, 24/860, 2600/D52, Pm8 and 24/2514.

Bacteria of the genus *Providencia* are infected by the following phage: PL25, PL26, PL37, 9211/9295, 9213/921 Ib, 9248, 7/R49, 7476/322, 7478/325, 7479, 7480, 9000/9402 and 9213/921 Ia.

Bacteria of the genus *Pseudomonas* are infected by the following phage: PfI, (syn=Pf-I), Pf2, Pf3, PP7, PRRI, 7s, im-*Pseudomonas* (1), AI-I, AI-2, B 17, B89, CB3, Col 2, Col 11, Col 18, Col 21, C154, C163, C167, C2121, E79, F8, ga, gb, H22, K1, M4, N2, Nu, PB-I, (syn=PBI), pfI6, PMN17, PPI, PP8, PsaI, PsPI, PsP2, PsP3, PsP4, PsP5, PS3, PS17, PTB80, PX4, PX7, PYOI, PYO2, PYO5, PYO6, PYO9, PYOIO, PYO13, PYO14, PYO16, PYO18, PYO19, PYO20, PYO29, PYO32, PYO33, PYO35, PYO36, PYO37, PYO38, PYO39, PYO41, PYO42, PYO45, PYO47, PYO48, PYO64, PYO69, PYO103, PIK, SLPI, SL2, S2, UNL-I, wy, Yai, Ya4, Yan, φBE, φCTX, φC17, φKZ, (syn=φKZ), φ-LT, φmu78, φNZ, φPLS-1, φST-1, φW-14, φ-2, 1/72, 2/79, 3, 3/DO, 4/237, 5/406, 6C, 6/6660, 7, 7v, 7/184, 8/280, 9/95, 10/502, 11/DE, 12/100, 12S, 16, 21, 24, 25F, 27, 31, 44, 68, 71, 95, 109, 188, 337, 352, 1214, HN-*Pseudomonas* (23), A856, B26, CI-I, CI-2, C5, D, gh-1, FI 16, HF, H90, K5, K6, KI 04, K109, K166, K267, N4, N5, O6N-25P, PE69, Pf, PPN25, PPN35, PPN89, PPN91, PP2, PP3, PP4, PP6, PP7, PP8, PP56, PP87, PPI 14, PP206, PP207, PP306, PP651, Psp231a, Pssy401, Pssy9220, psi, PTB2, PTB20, PTB42, PXI, PX3, PXIO, PX12, PX14, PYO70, PYO71, R, SH6, SH133, tf, Ya5, Ya7, φBS, φKf77, φ-MC, φmnF82, φPLS27, φPLS743, φS-1, 1, 2, 2, 3, 4, 5, 6, 7, 7, 8, 9, 10, 11, 12, 12B, 13, 14, 15, 14, 15, 16, 17, 18, 19, 20, 20, 21, 21, 22, 23, 23, 24, 25, 31, 53, 73, 119x, 145, 147, 170, 267, 284, 308, 525, NN-*Pseudomonas* (5), af, A7, B3, B33, B39, BI-I, C22, D3, D37, D40, D62, D3112, F7, FIO, g, gd, ge, gξ HwI2, Jb 19, KFI, L°, OXN-32P, O6N-52P, PCH-I, PC13-1, PC35-1, PH2, PH51, PH93, PH132, PMW, PM13, PM57, PM61, PM62, PM63, PM69, PM105, PMI 13, PM681, PM682, PO4, PPI, PP4, PP5, PP64, PP65, PP66, PP71, PP86, PP88, PP92, PP401, PP711, PP891, Pssy41, Pssy42, Pssy403, Pssy404, Pssy420, Pssy923, PS4, PS-IO, Pz, SDI, SLI, SL3, SL5, SM, φC5, φCI I, φCI I-1, φC13, φC15, φMO, φX, φO4, φI I, φ240, 2, 2F, 5, 7m, 11, 13, 13/441, 14, 20, 24, 40, 45, 49, 61, 73, 148, 160, 198, 218, 222, 236, 242, 246, 249, 258, 269, 295, 297, 309, 318, 342, 350, 351, 357-1, 400-1, HN-*Pseudomonas* (6), G101, M6, M6a, LI, PB2, PssyI5, Pssy4210, Pssy4220, PYO12, PYO34, PYO49, PYO50, PYO51, PYO52, PYO53, PYO57, PYO59, PYO200, PX2, PX5, SL4, φO3, φO6 and 1214.

Bacteria of the genus *Rickettsia* are infected by the following phage: NN-*Rickettsia*.

Bacteria of the genus *Salmonella* are infected by the following phage: b, Beccles, CT, d, Dundee, f, Fels 2, GI, GUI, GVI, GVIII, k, K, i, j, L, 01, (syn=0-1), (syn=O1), (syn=O-I), (syn=7), 02, 03, P3, P9a, PIO, Sab3, Sab5, SanIS, SanI7, SI, Taunton, ViI, (syn=ViI), 9, imSalmonella (1), N-I, N-5, N-IO, N-17, N-22, 11, 12, 16-19, 20.2, 36, 449C/C178, 966A/C259, a, B.A.O.R., e, G4, GUI, L, LP7, M, MG40, N-18, PSA68, P4, P9c, P22, (syn=P22), (syn=PLT22), (syn=PLT22), P22aI, P22-4, P22-7, P22-11, SNT-I, SNT-2, SP6, Villi, VilV, ViV, ViVI, ViVII, Worksop, Sj5, ε34, 1,37, 1(40), (syn=φI[40]), 1,422, 2, 2.5, 3b, 4, 5, 6,14(18), 8, 14(6,7), 10, 27, 28B, 30, 31, 32, 33, 34, 36, 37, 39, 1412, SNT-3, 7-11, 40.3, c, C236, C557, C625, C966N, g, GV, G5, GI 73, h, IRA, Jersey, MB78, P22-1, P22-3, P22-12, SabI, Sab2, Sab2, Sab4, SanI, San2, San3, San4, San6, San7, San8, San9, SanI3, SanI4, SanI5, SanI6, SanI8, SanI9, San20, San21, San22, San23, San24, San25, San26, SasLI, SasL2, SasL3, SasL4, SasL5, SIBL, SII, ViII, φI, 1, 2, 3a, 3a1, 1010, Ym-*Salmonella* (1), N-4, SasL6 and 27.

Bacteria of the genus *Serratia* are infected by the following phage: A2P, PS20, SMB3, SMP, SMP5, SM2, V40, V56, ic, φPCP-3, φPCP-6, 3M, 10/1a, 20A, 34CC, 34H, 38T, 345G, 345P, 501B, SMB2, SMP2, BC, BT, CW2, CW3, CW4, CW5, Lt232, L2232, L34, L.228, SLP, SMPA, V.43, σ, φCWI, φCP6-1, φCP6-2, φCP6-5, 3T, 5, 8, 9F, 10/1, 20E, 32/6, 34B, 34CT, 34P, 37, 41, 56, 56D, 56P, 6OP, 61/6, 74/6, 76/4, 101/8900, 226, 227, 228, 229F, 286, 289, 290F, 512, 764a, 2847/10, 2847/1Oa, L.359 and SMBI.

Bacteria of the genus *Shigella* are infected by the following phage: Fsa, (syn=a), FSD2d, (syn=D2d), (syn=W2d), FSD2E, (syn=W2e), fv, F6, f7.8, H-Sh, PES, P90, SfII, Sh, SHm, SHrv, (syn=HIV), SHvi, (syn=HVI), SHVvm, (syn=HVIII), SKγ66, (syn=gamma 66), (syn=yββ), (syn=γ66b), SKm, (syn=SIIIb)5 (syn=UI), SKw, (syn=Siva), (syn=IV), SIC™, (syn=SIVA), (syn=IVA), SKvi, (syn=KVI), (syn=Svi), (syn=VI), SKvm, (syn=Svm), (syn=VIII), SKVIIIA, (syn=SvmA), (syn=VIIIA), STvi, STK, STx1, STxn, S66, W2, (syn=D2c), (syn=D20), φI, φIVb 3-SO-R, 8368-SO-R, F7, (syn=FS7), (syn=K29), FIO, (syn=FSIO), (syn=K31), I1, (syn=alfa), (syn=FSa), (syn=KI 8), (syn=α), I2, (syn=a), (syn=KI9), SG33, (syn=G35), (syn=SO-35/G), SG35, (syn=SO-55/G), SG3201, (syn=SO-3201/G), SHn, (syn=HII), SHv, (syn=SHV), SHx, SHX, SKn, (syn=K2), (syn=KII), (syn=Sn), (syn=SsII), (syn=II), SKrv, (syn=Sm), (syn=SsIV), (syn=IV), SK1Va, (syn=Swab), (syn=SsIVa), (syn=IVa), SKV, (syn=K4), (syn=KV), (syn=SV), (syn=SsV), (syn=V), SKx, (syn=K9), (syn=KX), (syn=SX), (syn=SsX), (syn=X), STV, (syn=T35), (syn=35-50-R), STvm, (syn=T8345), (syn=8345-SO-S-R), W1, (syn=D8), (syn=FSD8), W2a, (syn=D2A), (syn=FS2a), DD-2, Sf6, FSi, (syn=FI), SF6, (syn=F6), SG42, (syn=SO-42/G), SG3203, (syn=SO-3203/G), SKF12, (syn=SsF12), (syn=F12), STn, (syn=1881-SO-R), γ66, (syn=gamma 66a), (syn=Ssγ66), φ2, BII, DDVII, (syn=DD7), FSD2b, (syn=W2B), FS2, (syn=F2), (syn=F2), FS4, (syn=F4), (syn=F4), FS5, (syn=F5), (syn=F5), FS9, (syn=F9), (syn=F9), FI I, P2-S0-S, SG36, (syn=SO-36/G), (syn=G36), SG3204, (syn=SO-3204/G), SG3244, (syn=SO-3244/G), SHi, (syn=HI), SHvrr, (syn=HVII), SHK, (syn=HIX), SHx1, SHxrr, (syn=HXn), SKI, KI, (syn=S1), (syn=SsI), SKVII, (syn=KVII), (syn=Svrr), (syn=SsVII), SKIX, (syn=KIX), (syn=S1x), (syn=SsIX), SKXII, (syn=KXII), (syn=Sxn), (syn=SsXII), STi, STffI, STrv, STVi, STvrr, S70, S206, U2-S0-S, 3210-SO-S, 3859-SO-S, 4020-SO-S, φ3, φ5, φ7, φ8, φ9, φIO, φI I, φI 3, φI4, φI8, SHm, (syn=Hπi), SHχi, (syn=HXt) and SKxI, (syn=KXI), (syn=Sχi), (syn=SsXI), (syn=XI).

Bacteria of the genus *Staphylococcus* are infected by the following phage: A, EW, K, Ph5, Ph9, PhIO, PhI3, PI, P2, P3, P4, P8, P9, PIO, RG, SB-i, (syn=Sb-I), S3K, Twort, φSK311, φ812, 06, 40, 58, 119, 130, 131, 200, 1623, STCI, (syn=stcI), STC2, (syn=stc2), 44AHJD, 68, ACI, AC2, A6"C", A9"C", b581, CA-I, CA-2, CA-3, CA-4, CA-5, DI I, L39x35, L54a, M42, NI, N2, N3, N4, N5, N7, N8, NIO, Ni I, N12, N13, N14, N16, Ph6, Phl2, Phl4, UC-18, U4, U15, SI, S2, S3, S4, S5, X2, Z1, φB5-2, φD, ω, 11, (syn=φI I), (syn=P11-M15), 15, 28, 28A, 29, 31, 31B, 37, 42D, (syn=P42D), 44A, 48, 51, 52, 52A, (syn=P52A), 52B, 53, 55, 69, 71, (syn=P71), 71A, 72, 75, 76, 77, 79, 80, 80α, 82, 82A, 83A, 84, 85, 86, 88, 88A, 89, 90, 92, 95, 96, 102, 107, 108, 111, 129-26, 130, 130A, 155, 157, 157A, 165, 187, 275, 275A, 275B, 356, 456, 459, 471, 471A, 489, 581, 676, 898, 1139, 1154A, 1259, 1314, 1380, 1405, 1563, 2148, 2638A, 2638B, 2638C, 2731, 2792A, 2792B, 2818, 2835, 2848A, 3619, 5841, 12100, AC3, A8, AIO, A13, b594n, D, HK2, N9, N15, P52, P87, SI, S6, Z4, φRE, 3A, 3B, 3C, 6, 7, 16, 21, 42B, 42C, 42E, 44, 47, 47A5 47C, 51, 54, 54x1, 70, 73, 75, 78, 81, 82, 88, 93, 94, 101, 105, 110, 115, 129/16, 174, 594n, 1363/14, 2460 and mS-*Staphylococcus* (1).

Bacteria of the genus *Streptococcus* are infected by the following phage: EJ-I, NN-Streptococais (1), a, CI, FL0Ths, H39, Cp-I, Cp-5, Cp-7, Cp-9, Cp-IO, AT298, A5, aIO/JI, aIO/J2, aIO/J5, aIO/J9, A25, BTI I, b6, CAI, c20-I, c20-2, DP-I, Dp-4, DTI, ET42, eIO, FA101, FEThs, Fκ, FKKIOI, FKLIO, FKP74, FKH, FLOTHs, FyIOI, fI, F10, F20140/76, g, GT-234, HB3, (syn=HB-3), HB-623, HB-746, M102, O1205, φ01205, PST, PO, PI, P2, P3, P5, P6, P8, P9, P9, P12, P13, P14, P49, P50, P51, P52, P53, P54, P55, P56, P57, P58, P59, P64, P67, P69, P71, P73, P75, P76, P77, P82, P83, P88, sc, sch, sf, SfII 1, (syn=SFiI I), (syn=φSFiII), (syn=φSfiI I), (syn=φSfiI I), sfiI9, (syn=SFiI9), (syn=φSFiI9), (syn=φSfiI9), Sfi21, (syn=SFi21), (syn=φSFi21), (syn=φSfi21), STO, STX, st2, ST2, ST4, S3, (syn=φS3), s265, $^{SM}$17, φ42, φ57, φ80, φ81, φ82, φ83, φ84, φ85, φ86, φ87, φ88, φ89, φ90, φ91, φ92, φ93, φ94, φ95, φ96, φ97, φ98, φ99, φIOO, φIOI, φIO2, φ227, φ7201, ωI, ω2, ω3, ω4, ω5, ω6, ω8, ωIO, 1, 6, 9, 1OF, 12/12, 14, 17SR, 19S, 24, 50/33, 50/34, 55/14, 55/15, 70/35, 70/36, 71/ST15, 71/45, 71/46, 74F, 79/37, 79/38, 80/J4, 80/J9, 80/ST16, 80/15, 80/47, 80/48, 101, 103/39, 103/40, 121/41, 121/42, 123/43, 123/44, 124/44, 337/ST17 and mStreptococcus (34).

Bacteria of the genus *Treponema* are infected by the following phage: NN-*Treponema* (1).

Bacteria of the genus *Vibrio* are infected by the following phage: CTXφ, fs, (syn=si), fs2, Ivpf5, VfI2, Vf33, VPIφ, VSK, v6, 493, CP-TI, ET25, kappa, KI39, Labol, )XN-69P, OXN-86, O6N-21P, PB-I, P147, rp-1, SE3, VA-I, (syn=VcA-I), VcA-2, VPI, VP2, VP4, VP7, VP8, VP9, VPIO, VP17, VP18, VP19, X29, (syn=29 d'Herelle), t, φHAWI-1, φHAWI-2, φHAWI-3, φHAWI-4, φHAWI-5, φHAWI-6, φHAWI-7, XHAWI-8, φHAWI-9, φHAWI-10, φHCI-1, φHC1-2, φHC1-3, φHC1-4, φHC2-1, >HC2-2, φHC2-3, φHC2-4, φHC3-1, φHC3-2, φHC3-3, φHD1S-1, φHD1S-2, φHD2S-1, φHD2S-2, φHD2S-3, φHD2S-4, φHD2S-5, φHDO-1, φHDO-2, φHDO-3, φHDO-4, φHDO-5, φHDO-6, φKL-33, φKL-34, φKL-35, φKL-36, φKWH-2, φKWH-3, φKWH-4, φMARQ-1, φMARQ-2, φMARQ-3, φMOAT-1, φO139, φPEL1A-1, φPEL1A-2, φPEL8A-1, φPEL8A-2, φPEL8A-3, φPEL8C-1, φPEL8C-2, φPEL13A-1, φPEL13B-1, φPEL13B-2, φPEL13B-3, φPEL13B-4, φPEL13B-5, φPEL13B-6, φPEL13B-7, φPEL13B-8, φPEL13B-9, φPEL13B-10, φVP143, φVP253, φ16, φI38, 1-II, 5, 13, 14, 16, 24, 32, 493, 6214, 7050, 7227, II, (syn=group II), (syn==φ2), V, VIII, ~m-*Vibrio* (13), KVP20, KVP40, nt-1, O6N-22P, P68, eI, e2, e3, e4, e5, FK, G, I, K, nt-6, NI, N2, N3, N4, N5, O6N-34P, OXN-72P, OXN-85P, OXN-100P, P, Ph-I, PL163/10, Q, S, T, φ92, 1-9, 37, 51, 57, 70A-8, 72A-4, 72A-10, 110A-4, 333, 4996, I (syn=group I), III (syn=group III), VI, (syn=A-Saratov), VII, IX, X, HN-*Vibrio* (6), pAI, 7, 7-8, 70A-2, 71A-6, 72A-5, 72A-8, 108A-10, 109A-6, 109A-8, IIOA-1, IIOA-5, IIOA-7, by-1, OXN-52P, P13, P38, P53, P65, P108, Pill, TP13 VP3, VP6, VP12, VP13, 70A-3, 70A-4, 70A-10, 72A-1, 108A-3, 109-B1, 110A-2, 149, (syn=T149), IV, (syn=group IV), NN-*Vibrio* (22), VPS, VPII, VP15, VP16, αI, α2, α3a, α3b, 353B and HN-*Vibrio* (7).

Bacteria of the genus *Yersinia* are infected by the following phage: H, H-I, H-2, H-3, H-4, Lucas 110, Lucas 303, Lucas 404, YerA3, YerA7, YerA20, YerA41, 3/M64-76, 5/G394-76, 6/C753-76, 8/C239-76, 9/F18167, 1701, 1710, PST, 1/F2852-76, D'Herelle, EV, H, Kotljarova, PTB, R, Y, YerA41, φYerO3-12, 3, 4/01324-76, 7/F783-76, 903, 1/M6176 and Yer2AT.

More preferably, the bacteriophage is selected in the group consisting of Salmonella virus SKML39, Shigella virus AG3, Dickeya virus Limestone, Dickeya virus RC2014, Escherichia virus CBA120, Escherichia virus PhaxI, Salmonella virus 38, Salmonella virus Det7, Salmonella virus GG32, Salmonella virus PM10, Salmonella virus SFP10, Salmonella virus SH19, Salmonella virus SJ3, Escherichia virus ECML4, Salmonella virus Marshall, Salmonella virus Maynard, Salmonella virus SJ2, Salmonella virus STML131, Salmonella virus ViI, Erwinia virus Ea2809, Klebsiella virus 0507KN21, Serratia virus IME250, Serratia virus MAM1, Campylobacter virus CP21, Campylobacter virus CP220, Campylobacter virus CPt10, Campylobacter virus IBB35, Campylobacter virus CP81, Campylobacter virus CP30A, Campylobacter virus CPX, Campylobacter virus NCTC12673, Erwinia virus Ea214, Erwinia virus M7, Escherichia virus AYO145A, Escherichia virus EC6, Escherichia virus HY02, Escherichia virus JH2, Escherichia virus TP1, Escherichia virus VpaE1, Escherichia virus wV8, Salmonella virus FelixO1, Salmonella virus HB2014, Salmonella virus Mushroom, Salmonella virus UAB87, Citrobacter virus Moogle, Citrobacter virus Mordin, Escherichia virus SUSP1, Escherichia virus SUSP2, Aeromonas virus phiO18P, Haemophilus virus HP1, Haemophilus virus HP2, Pasteurella virus F108, Vibrio virus KI39, Vibrio virus Kappa, Burkholderia virus phi52237, Burkholderia virus phiE122, Burkholderia virus phiE202, Escherichia virus 186, Escherichia virus P4, Escherichia virus P2, Escherichia virus Wphi, Mannheimia virus PHL101, Pseudomonas virus phiCTX, Ralstonia virus RSA1, Salmonella virus Fels2, Salmonella virus PsP3, Salmonella virus SopEphi, Yersinia virus L413C, Staphylococcus virus G1, Staphylococcus virus G15, Staphylococcus virus JD7, Staphylococcus virus K, Staphylococcus virus MCE2014, Staphylococcus virus P108, Staphylococcus virus Rodi, Staphylococcus virus S253, Staphylococcus virus S25-4, Staphylococcus virus SA12, Listeria virus A511, Listeria virus P100, Staphylococcus virus Remus, Staphylococcus virus SA11, Staphylococcus virus Stau2, Bacillus virus Camphawk, Bacillus virus SPO1, Bacillus virus BCP78, Bacillus virus TsarBomba, Staphylococcus virus Twort, Enterococcus virus phiEC24C, Lactobacillus virus Lb338-1, Lactobacillus virus LP65, Enterobacter virus PG7, Escherichia virus CC31, Klebsiella virus JD18, Klebsiella virus PKO111, Escherichia virus Bp7, Escherichia virus IME08, Escherichia virus JS10, Escherichia virus JS98, Escherichia virus QL01, Escherichia virus VR5, Enterobacter virus Eap3, Klebsiella virus KP15, Klebsiella virus KP27, Klebsiella virus Matisse, Klebsiella virus Miro, Citrobacter virus Merlin, Citrobacter virus Moon, Escherichia virus JSE, Escherichia virus phi1, Escherichia virus RB49, Escherichia virus HX01, Escherichia virus J509, Escherichia virus RB69, Shigella virus UTAM, Salmonella virus S16, Salmonella virus STML198, Vibrio virus KVP40, Vibrio virus nt1, Vibrio virus ValKK3, Escherichia virus VR7, Escherichia virus VR20, Escherichia virus VR25, Escherichia virus VR26, Shigella virus SP18, Escherichia virus AR1, Escherichia virus C40, Escherichia virus E112, Escherichia virus ECML134, Escherichia virus HY01, Escherichia virus Ime09, Escherichia virus RB3, Escherichia virus RB14, Escherichia virus T4, Shigella virus Pss1, Shigella virus Shfl2, Yersinia virus D1, Yersinia virus PST, Acinetobacter virus 133, Aeromonas virus 65, Aeromonas virus Aeh1, Escherichia virus RB16, Escherichia virus RB32, Escherichia virus RB43, Pseudomonas virus 42, Cronobacter virus CR3, Cronobacter virus CR8, Cronobacter virus CR9, Cronobacter virus PBES02, Pectobacterium virus phiTE, Cronobacter virus GAP31, Escherichia virus 4MG, Salmonella virus SE1, Salmonella virus SSE121, Escherichia virus FFH2, Escherichia virus FV3, Escherichia virus JES2013, Escherichia virus V5, Brevibacillus virus Abouo, Brevibacillus virus Davies, Bacillus virus Agate, Bacillus virus Bobb, Bacillus virus Bp8pC, Erwinia virus Deimos, Erwinia virus Ea35-70, Erwinia virus RAY, Erwinia virus Simmy50, Erwinia virus SpecialG, Acinetobacter virus AB1, Acinetobacter virus AB2, Acinetobacter virus AbC62, Acinetobacter virus AP22, Arthrobacter virus ArV1, Arthrobacter virus Trina, Bacillus virus AvesoBmore, Bacillus virus B4, Bacillus virus Bigbertha, Bacillus virus Riley, Bacillus virus Spock, Bacillus virus Troll, Bacillus virus Bastille, Bacillus virus CAM003, Bacillus virus Bc431, Bacillus virus Bcp1, Bacillus virus BCP82, Bacillus virus BM15, Bacillus virus Deepblue, Bacillus virus JBP901, Burkholderia virus Bcep1, Burkholderia virus Bcep43, Burkholderia virus Bcep781, Burkholderia virus BcepNY3, Xanthomonas virus OP2, Burkholderia virus BcepMu, Burkholderia virus phiE255, Aeromonas virus 44RR2, Mycobacterium virus Alice, Mycobacterium virus Bxz1, Mycobacterium virus Dandelion, Mycobacterium virus HyRo, Mycobacterium virus 13, Mycobacterium virus Nappy, Mycobacterium virus Sebata, Clostridium virus phiC2, Clostridium virus phiCD27, Clostridium virus phiCD119, Bacillus virus CP51, Bacillus virus JL, Bacillus virus Shanette, Escherichia virus CVM10, Escherichia virus ep3, Erwinia virus Asesino, Erwinia virus EaH2, Pseudomonas virus EL, Halomonas virus HAP1, Vibrio virus VP882, Brevibacillus virus Jimmer, Brevibacillus virus Osiris, Pseudomonas virus Ab03, Pseudomonas virus KPP10, Pseudomonas virus PAKP3, Sinorhizobium virus M7, Sinorhizobium virus M12, Sinorhizobium virus N3, Erwinia virus Machina, Arthrobacter virus Brent, Arthrobacter virus Jawnski, Arthrobacter virus Martha, Arthrobacter virus Sonny, Edwardsiella virus MSW3, Edwardsiella virus PEi21, Escherichia virus Mu, Shigella virus SfMu, Halobacterium virus phiH, Bacillus virus Grass, Bacillus virus NIT1, Bacillus virus SPG24, Aeromonas virus 43, Escherichia virus P1, Pseudomonas virus CAb1, Pseudomonas virus CAb02, Pseudomonas virus JG004, Pseudomonas virus PAKP1, Pseudomonas virus PAKP4, Pseudomonas virus PaP1, Burkholderia virus BcepF1, Pseudomonas virus 141, Pseudomonas virus Ab28, Pseudomonas virus DL60, Pseudomonas virus DL68, Pseudomonas virus F8, Pseudomonas virus JG024, Pseudomonas virus KPP12, Pseudomonas virus LBL3, Pseudomonas virus LMA2, Pseudomonas virus PB1, Pseudomonas virus SN, Pseudomonas virus PA7, Pseudomonas virus phiKZ, Rhizobium virus RHEph4, Ralstonia virus RSF1, Ralstonia virus RSL2, Ralstonia virus RSL1, Aeromonas virus 25, Aeromonas virus 31, Aeromonas virus Aes12, Aeromonas virus Aes508, Aeromonas virus AS4, Stenotrophomonas virus IME13, Staphylococcus virus IPLAC1C, Staphylococcus virus SEP1, Salmonella virus SPN3US, Bacillus virus 1, Geobacillus virus GBSV1, Yersinia virus R1RT, Yersinia virus TG1, Bacillus virus G, Bacillus virus PBS1, Microcystis virus Ma-LMM01, Vibrio virus MAR, Vibrio virus VHML, Vibrio virus VP585, Bacillus virus BPS13, Bacillus virus Hakuna, Bacillus virus Megatron, Bacillus virus WPh, Acinetobacter virus AB3, Acinetobacter virus Abp1, Acinetobacter virus Fri1, Acinetobacter virus IME200, Acinetobacter virus PD6A3, Acinetobacter virus PDAB9, Acinetobacter virus phiAB1, Escherichia virus K30, Klebsiella virus K5, Klebsiella virus KI1, Klebsiella virus Kp1, Klebsiella virus KP32, Klebsiella virus KpV289, Klebsiella virus F19, Klebsiella virus K244, Klebsiella virus Kp2, Klebsiella virus KP34, Klebsiella virus KpV41, Klebsiella virus KpV71, Klebsiella virus KpV475, Klebsiella virus SU503, Klebsiella virus SU552A, Pantoea virus Limelight, Pantoea virus Limezero, Pseudomonas virus LKA1, Pseudomonas virus phiKMV, Xanthomonas virus f20, Xanthomonas virus f30, Xylella virus Prado, Erwinia virus Era103, Escherichia virus K5, Escherichia virus KI-5, Escherichia virus KIE, Salmonella virus SP6, Escherichia virus T7, Kluyvera virus Kvp1, Pseudomonas virus gh1, Prochlorococcus virus PSSP7, Synechococcus virus P60, Synechococcus virus SynS, Streptococcus virus Cp1, Streptococcus virus Cp7, Staphylococcus virus 44AHJD, Streptococcus virus C1, Bacillus virus B103, Bacillus virus GA1, Bacillus virus phi29, Kurthia virus 6, Actinomyces virus Av1, Mycoplasma virus P1, Escherichia virus 24B, Escherichia virus 933W, Escherichia virus Min27, Escherichia virus PA28, Escherichia virus Stx2 II, Shigella virus 7502Stx, Shigella virus POCJ13, Escherichia virus 191, Escherichia virus PA2, Escherichia virus TL2011, Shigella virus VASD, Burkholderia virus Bcep22, Burkholderia virus BcepiI02, Burkholderia virus BcepmigI, Burkholderia virus DC1, Bordetella virus BPP1, Burkholderia virus BcepC6B, Cellulophaga virus Cba41, Cellulophaga virus Cba172, Dinoroseobacter virus DFL12, Erwinia virus Ea9-2, Erwinia virus Frozen, Escherichia virus phiV10, Salmonella virus Epsilon15, Salmonella virus SPN1S, Pseudomonas virus F116, Pseudomonas virus H66, Escherichia virus APECS, Escherichia virus APEC7, Escherichia virus Bp4, Escherichia virus EC1UPM, Escherichia virus ECBP1, Escherichia virus G7C, Escherichia virus IME11, Shigella virus Sb1, Achromobacter virus Axp3, Achromobacter virus JWAlpha, Edwardsiella virus KF1, Pseudomonas virus KPP25, Pseudomonas virus R18, Pseudomonas virus Ab09, Pseudomonas virus LIT1, Pseudomonas virus PA26, Pseudomonas virus Ab22, Pseudomonas virus CHU, Pseudomonas virus LUZ24, Pseudomonas virus PAA2, Pseudomonas virus PaP3, Pseudomonas virus PaP4, Pseudomonas virus TL, Pseudomonas virus KPP21, Pseudomonas virus LUZ7, Escherichia virus N4, Salmonella virus 9NA, Salmonella virus SP069, Salmonella virus BTP1, Salmonella virus HK620, Salmonella virus P22, Salmonella virus ST64T, Shigella virus Sf6, Bacillus virus Page, Bacillus virus Palmer, Bacillus virus Pascal, Bacillus virus Pony, Bacillus virus Pookie, Escherichia virus 172-1, Escherichia virus ECB2, Escherichia virus NJ01, Escherichia virus phiEco32, Escherichia virus Septima11, Escherichia virus SU10, Brucella virus Pr, Brucella virus Tb, Escherichia virus Pollock, Salmonella virus FSL SP-058, Salmonella virus FSL SP-076, Helicobacter virus 1961P, Helicobacter virus KHP30, Helicobacter virus KHP40, Hamiltonella virus APSE1, Lactococcus virus KSY1, Phormidium virus WMP3, Phormidium virus WMP4, Pseudomonas virus 119X, Roseobacter virus SIO1, Vibrio virus VpV262, Vibrio virus VC8, Vibrio virus VP2, Vibrio virus VP5, Streptomyces virus Amela, Streptomyces virus phiCAM, Streptomyces virus Aaronocolus, Streptomyces virus Caliburn, Streptomyces virus Danzina, Streptomyces virus Hydra, Streptomyces virus Izzy, Streptomyces virus Lannister, Streptomyces virus Lika, Streptomyces virus Sujidade, Streptomyces virus Zemlya, Streptomyces virus ELB20, Streptomyces virus R4, Streptomyces virus phi- Hau3, Mycobacterium virus Acadian, Mycobacterium virus Baee, Mycobacterium virus Reprobate, Mycobacterium virus Adawi, Mycobacterium virus Bane1, Mycobacterium virus BrownCNA, Mycobacterium virus Chrisnmich, Mycobacterium virus Cooper, Mycobacterium virus JAMaL, Mycobacterium virus Nigel, Mycobacterium virus Stinger, Mycobacterium virus Vincenzo, Mycobacterium virus Zemanar, Mycobacterium virus Apizium, Mycobacterium virus Manad, Mycobacterium virus Oline, Mycobacterium virus Osmaximus, Mycobacterium virus Pg1, Mycobacterium virus Soto, Mycobacterium virus Suffolk, Mycobacterium virus Athena, Mycobacterium virus Bernardo, Mycobacterium virus Gadjet, Mycobacterium virus Pipefish, Mycobacterium virus Godines, Mycobacterium virus Rosebush, Mycobacterium virus Babsiella, Mycobacterium virus Brujita, Mycobacterium virus Che9c, Mycobacterium virus Sbash, Mycobacterium virus Hawkeye, Mycobacterium virus Plot, Salmonella virus AG11, Salmonella virus Ent1, Salmonella virus f18SE, Salmonella virus Jersey, Salmonella virus L13, Salmonella virus LSPA1, Salmonella virus SE2, Salmonella virus SETP3, Salmonella virus SETP7, Salmonella virus SETP13, Salmonella virus SP101, Salmonella virus SS3e, Salmonella virus wksI3, Escherichia virus KIG, Escherichia virus KIH, Escherichia virus K1ind1, Escherichia virus K1ind2, Salmonella virus SP31, Leuconostoc virus Lmd1, Leuconostoc virus LN03, Leuconostoc virus LN04, Leuconostoc virus LN12, Leuconostoc virus LN6B, Leuconostoc virus P793, Leuconostoc virus 1A4, Leuconostoc virus Ln8, Leuconostoc virus Ln9, Leuconostoc virus LN25, Leuconostoc virus LN34, Leuconostoc virus LNTR3, Mycobacterium virus Bongo, Mycobacterium virus Rey, Mycobacterium virus Butters, Mycobacterium virus Michelle, Mycobacterium virus Charlie, Mycobacterium virus Pipsqueaks, Mycobacterium virus Xeno, Mycobacterium virus Panchino, Mycobacterium virus Phrann, Mycobacterium virus Redi, Mycobacterium virus Skinnyp, Gordonia virus BaxterFox, Gordonia virus Yeezy, Gordonia virus Kita, Gordonia virus Zirinka, Gorrdonia virus Nymphadora, Mycobacterium virus Bignuz, Mycobacterium virus Brusacoram, Mycobacterium virus Donovan, Mycobacterium virus Fishburne, Mycobacterium virus Jebeks, Mycobacterium virus Malithi, Mycobacterium virus Phayonce, Enterobacter virus F20, Klebsiella virus 1513, Klebsiella virus KLPN1, Klebsiella virus KP36, Klebsiella virus PKP126, Klebsiella virus Sushi, Escherichia virus AHP42, Escherichia virus AHS24, Escherichia virus AKS96, Escherichia virus C119, Escherichia virus E41c, Escherichia virus Eb49, Escherichia virus Jk06, Escherichia virus KP26, Escherichia virus Rogue1, Escherichia virus ACGM12, Escherichia virus Rtp, Escherichia virus ADB2, Escherichia virus JMPW1, Escherichia virus JMPW2, Escherichia virus T1, Shigella virus PSf2, Shigella virus Shfl1, Citrobacter virus Stevie, Escherichia virus TLS, Salmonella virus SP126, Cronobacter virus Esp2949-1, Pseudomonas virus Ab18, Pseudomonas virus Ab19, Pseudomonas virus PaMx11, Arthrobacter virus Amigo, Propionibacterium virus Anatole, Propionibacterium virus B3, Bacillus virus Andromeda, Bacillus virus Blastoid, Bacillus virus Curly, Bacillus virus Eoghan, Bacillus virus Finn, Bacillus virus Glittering, Bacillus virus Riggi, Bacillus virus Taylor, Gordonia virus Attis, Mycobacterium virus Barnyard, Mycobacterium virus Konstantine, Mycobacterium virus Predator, Mycobacterium virus Bernal13, Staphylococcus virus 13, Staphylococcus virus 77, Staphylococcus virus 108PVL, Mycobacterium virus Bron, Mycobacterium virus Faith1, Mycobacterium virus Joedirt, Mycobacterium virus Rumpelstiltskin, Lactococcus virus bIL67, Lactococcus virus c2, Lactobacillus virus c5, Lactobacillus virus Ld3, Lactobacillus virus Ld17, Lactobacillus virus Ld25A, Lactobacillus virus LLKu, Lactobacillus virus phiLdb, Cellulophaga virus Cba121, Cellulophaga virus Cba171, Cellulophaga virus Cba181, Cellulophaga virus ST, Bacillus virus 250, Bacillus virus IEBH, Mycobacterium virus Ardmore, Mycobacterium virus Avani, Mycobacterium virus Boomer, Mycobacterium virus Che8, Mycobacterium virus Che9d, Mycobacterium virus Deadp, Mycobacterium virus Dlane, Mycobacterium virus Dorothy, Mycobacterium virus Dotproduct, Mycobacterium virus Drago, Mycobacterium virus Fruitloop, Mycobacterium virus Gumbie, Mycobacterium virus Ibhubesi, Mycobacterium virus Llij, Mycobacterium virus Mozy, Mycobacterium virus Mutaforma13, Mycobacterium virus Pacc40, Mycobacterium virus PMC, Mycobacterium virus Ramsey, Mycobacterium virus Rockyhorror, Mycobacterium virus SG4, Mycobacterium virus Shaunal, Mycobacterium virus Shilan, Mycobacterium virus Spartacus, Mycobacterium virus Taj, Mycobacterium virus Tweety, Mycobacterium virus Wee, Mycobacterium virus Yoshi, Salmonella virus Chi, Salmonella virus FSLSP030, Salmonella virus FSLSP088, Salmonella virus iEPS5, Salmonella virus SPN19, Mycobacterium virus 244, Mycobacterium virus Bask21, Mycobacterium virus CJW1, Mycobacterium virus Eureka, Mycobacterium virus Kostya, Mycobacterium virus Porky, Mycobacterium virus Pumpkin, Mycobacterium virus Sirduracell, Mycobacterium virus Toto, Mycobacterium virus Corndog, Mycobacterium virus Firecracker, Rhodobacter virus RcCronus, Pseudomonas virus D3112, Pseudomonas virus DMS3, Pseudomonas virus FHA0480, Pseudomonas virus LPB1, Pseudomonas virus MP22, Pseudomonas virus MP29, Pseudomonas virus MP38, Pseudomonas virus PA1KOR, Pseudomonas virus D3, Pseudomonas virus PMG1, Arthrobacter virus Decurro, Gordonia virus Demosthenes, Gordonia virus Katyusha, Gordonia virus Kvothe, Propionibacterium virus B22, Propionibacterium virus Doucette, Propionibacterium virus E6, Propionibacterium virus G4, Burkholderia virus phi6442, Burkholderia virus phi1026b, Burkholderia virus phiE125, Edwardsiella virus eiAU, Mycobacterium virus Ff47, Mycobacterium virus Muddy, Mycobacterium virus Gaia, Mycobacterium virus Giles, Arthrobacter virus Captnmurica, Arthrobacter virus Gordon, Gordonia virus GordTnk2, Paenibacillus virus Harrison, Escherichia virus EK99P1, Escherichia virus HK578, Escherichia virus JL1, Escherichia virus SSL2009a, Escherichia virus YD2008s, Shigella virus EP23, Sodalis virus SO1, Escherichia virus HK022, Escherichia virus HK75, Escherichia virus HK97, Escherichia virus HK106, Escherichia virus HK446, Escherichia virus HK542, Escherichia virus HK544, Escherichia virus HK633, Escherichia virus mEp234, Escherichia virus mEp235, Escherichia virus mEpX1, Escherichia virus mEpX2, Escherichia virus mEp043, Escherichia virus mEp213, Escherichia virus mEp237, Escherichia virus mEp390, Escherichia virus mEp460, Escherichia virus mEp505, Escherichia virus mEp506, Brevibacillus virus Jenst, Achromobacter virus 83-24, Achromobacter virus JWX, Arthrobacter virus Kellezzio, Arthrobacter virus Kitkat, Arthrobacter virus Bennie, Arthrobacter virus DrRobert, Arthrobacter virus Glenn, Arthrobacter virus HunterDalle, Arthrobacter virus Joann, Arthrobacter virus Korra, Arthrobacter virus Preamble, Arthrobacter virus Pumancara, Arthrobacter virus Wayne, Mycobacterium virus Alma, Mycobacterium virus Arturo, Mycobacterium virus Astro, Mycobacterium virus Backyardigan, Mycobacterium virus BBPiebs31, Mycobacterium virus Benedict, Mycobacterium virus Bethlehem, Mycobacterium virus Billknuckles, Mycobacterium virus Bruns, Mycobacterium virus Bxb1, Mycobacterium virus Bxz2, Mycobacterium virus Che12, Mycobacterium virus Cuco, Mycobacterium virus D29, Mycobacterium virus Doom, Mycobacterium virus Ericb, Mycobacterium virus Euphoria, Mycobacterium virus George, Mycobacterium virus Gladiator, Mycobacterium virus Goose, Mycobacterium virus Hammer, Mycobacterium virus Heldan, Mycobacterium virus Jasper, Mycobacterium virus JC27, Mycobacterium virus Jeffabunny, Mycobacterium virus JHC117, Mycobacterium virus KBG, Mycobacterium virus Kssjeb, Mycobacterium virus Kugel, Mycobacterium virus L5, Mycobacterium virus Lesedi, Mycobacterium virus LHTSCC, Mycobacterium virus lockley, Mycobacterium virus Marcell, Mycobacterium virus Microwolf, Mycobacterium virus Mrgordo, Mycobacterium virus Museum, Mycobacterium virus Nepal, Mycobacterium virus Packman, Mycobacterium virus Peaches, Mycobacterium virus Perseus, Mycobacterium virus Pukovnik, Mycobacterium virus Rebeuca, Mycobacterium virus Redrock, Mycobacterium virus Ridgecb, Mycobacterium virus Rockstar, Mycobacterium virus Saintus, Mycobacterium virus Skipole, Mycobacterium virus Solon, Mycobacterium virus Switzer, Mycobacterium virus SWU1, Mycobacterium virus Ta17a, Mycobacterium virus Tiger, Mycobacterium virus Timshel, Mycobacterium virus Trixie, Mycobacterium virus Turbido, Mycobacterium virus Twister, Mycobacterium virus U2, Mycobacterium virus Violet, Mycobacterium virus Wonder, Escherichia virus DE3, Escherichia virus HK629, Escherichia virus HK630, Escherichia virus Lambda, Arthrobacter virus Laroye, Mycobacterium virus Halo, Mycobacterium virus Liefie, Mycobacterium virus Marvin, Mycobacterium virus Mosmoris, Arthrobacter virus Circum, Arthrobacter virus Mudcat, Escherichia virus N15, Escherichia virus 9g, Escherichia virus JenKI, Escherichia virus JenP1, Escherichia virus JenP2, Pseudomonas virus NP1, Pseudomonas virus PaMx25, Mycobacterium virus Baka, Mycobacterium virus Courthouse, Mycobacterium virus Littlee, Mycobacterium virus Omega, Mycobacterium virus Optimus, Mycobacterium virus Thibault, Polaribacter virus P12002L, Polaribacter virus P12002S, Nonlabens virus P12024L, Nonlabens virus P12024S, Thermus virus P23-45, Thermus virus P74-26, Listeria virus LP26, Listeria virus LP37, Listeria virus LP110, Listeria virus LP114, Listeria virus P70, Propionibacterium virus ATCC29399BC, Propionibacterium virus ATCC29399BT, Propionibacterium virus Attacne, Propionibacterium virus Keiki, Propionibacterium virus Kubed, Propionibacterium virus Lauchelly, Propionibacterium virus MrAK, Propionibacterium virus Ouroboros, Propionibacterium virus P91, Propionibacterium virus P105, Propionibacterium virus P144, Propionibacterium virus P1001, Propionibacterium virus P1.1, Propionibacterium virus P100A, Propionibacterium virus P100D, Propionibacterium virus P101A, Propionibacterium virus P104A, Propionibacterium virus PA6, Propionibacterium virus Pacnes201215, Propionibacterium virus PAD20, Propionibacterium virus PAS50, Propionibacterium virus PHLOO9M11, Propionibacterium virus PHL025M00, Propionibacterium virus PHL037M02, Propionibacterium virus PHL041M10, Propionibacterium virus PHL060L00, Propionibacterium virus PHL067M01, Propionibacterium virus PHL070N00, Propionibacterium virus PHL071N05, Propionibacterium virus PHL082M03, Propionibacterium virus PHL092M00, Propionibacterium virus PHL095N00, Propionibacterium virus PHL111M01, Propionibacterium virus PHL112N00, Propionibacterium virus PHL113M01, Propionibacterium virus PHL114L00, Propionibacterium virus PHL116M00, Propionibacterium virus PHL117M00, Propionibacterium virus PHL117M01, Propionibacterium virus PHL132N00, Propionibacterium virus PHL141N00, Propionibacterium virus PHL151M00, Propionibacterium virus PHL151N00, Propionibacterium virus PHL152M00, Propionibacterium virus PHL163M00, Propionibacterium virus PHL171M01, Propionibacterium virus PHL179M00, Propionibacterium virus PHL194M00, Propionibacterium virus PHL199M00, Propionibacterium virus PHL301M00, Propionibacterium virus PHL308M00, Propionibacterium virus Pirate, Propionibacterium virus Procrass1, Propionibacterium virus SKKY, Propionibacterium virus Solid, Propionibacterium virus Stormborn, Propionibacterium virus Wizzo, Pseudomonas virus PaMx28, Pseudomonas virus PaMx74, Mycobacterium virus Patience, Mycobacterium virus PBI1, Rhodococcus virus Pepy6, Rhodococcus virus Poco6, Propionibacterium virus PFR1, Streptomyces virus phiBT1, Streptomyces virus phiC31, Streptomyces virus TG1, Caulobacter virus Karma, Caulobacter virus Magneto, Caulobacter virus phiCbK, Caulobacter virus Rogue, Caulobacter virus Swift, Staphylococcus virus 11, Staphylococcus virus 29, Staphylococcus virus 37, Staphylococcus virus 53, Staphylococcus virus 55, Staphylococcus virus 69, Staphylococcus virus 71, Staphylococcus virus 80, Staphylococcus virus 85, Staphylococcus virus 88, Staphylococcus virus 92, Staphylococcus virus 96, Staphylococcus virus 187, Staphylococcus virus 52a, Staphylococcus virus 80alpha, Staphylococcus virus CNPH82, Staphylococcus virus EW, Staphylococcus virus IPLA5, Staphylococcus virus IPLA7, Staphylococcus virus IPLA88, Staphylococcus virus PH15, Staphylococcus virus phiETA, Staphylococcus virus phiETA2, Staphylococcus virus phiETA3, Staphylococcus virus phiMR11, Staphylococcus virus phiMR25, Staphylococcus virus phiNM1, Staphylococcus virus phiNM2, Staphylococcus virus phiNM4, Staphylococcus virus SAP26, Staphylococcus virus X2, Enterococcus virus FL1, Enterococcus virus FL2, Enterococcus virus FL3, Lactobacillus virus ATCC8014, Lactobacillus virus phiJL1, Pediococcus virus cIP1, Aeromonas virus pIS4A, Listeria virus LP302, Listeria virus PSA, Methanobacterium virus psiM1, Roseobacter virus RDJL1, Roseobacter virus RDJL2, Rhodococcus virus RER2, Enterococcus virus BC611, Enterococcus virus IMEEF1, Enterococcus virus SAP6, Enterococcus virus VD13, Streptococcus virus SPQS1, Mycobacterium virus Papyrus, Mycobacterium virus Send513, Burkholderia virus KL1, Pseudomonas virus 73, Pseudomonas virus Ab26, Pseudomonas virus Kakheti25, Escherichia virus Cajan, Escherichia virus Seurat, Staphylococcus virus SEP9, Staphylococcus virus Sextaec, Streptococcus virus 858, Streptococcus virus 2972, Streptococcus virus ALQ132, Streptococcus virus 01205, Streptococcus virus Sfi11, Streptococcus virus 7201, Streptococcus virus DT1, Streptococcus virus phiAbc2, Streptococcus virus Sfi19, Streptococcus virus Sfi21, Paenibacillus virus Diva, Paenibacillus virus Hb10c2, Paenibacillus virus Rani, Paenibacillus virus Shelly, Paenibacillus virus Sitara, Paenibacillus virus Willow, Lactococcus virus 712, Lactococcus virus ASCC191, Lactococcus virus ASCC273, Lactococcus virus ASCC281, Lactococcus virus ASCC465, Lactococcus virus ASCC532, Lactococcus virus Bibb29, Lactococcus virus bIL170, Lactococcus virus CB13, Lactococcus virus CB14, Lactococcus virus CB19, Lactococcus virus CB20, Lactococcus virus jj50, Lactococcus virus P2, Lactococcus virus P008, Lactococcus virus ski, Lactococcus virus SI4, Bacillus virus Slash, Bacillus virus Stahl, Bacillus virus Staley, Bacillus virus Stills, Gordonia virus Bachita, Gordonia virus ClubL, Gordonia virus OneUp, Gordonia virus Smoothie, Gordonia virus Soups, Bacillus virus SPbeta, Vibrio virus MAR10, Vibrio virus SSP002, Escherichia virus AKFV33, Escherichia virus BF23, Escherichia virus DT57C, Escherichia virus EPS7, Escherichia virus FFH1, Escherichia virus H8, Escherichia virus slur09, Escherichia virus T5, Salmonella virus 118970sal2, Salmonella virus Shivani, Salmonella virus SPC35, Salmonella virus Stitch, Arthrobacter virus Tank, Tsukamurella virus TIN2, Tsukamurella virus TIN3, Tsukamurella virus TIN4, Rhodobacter virus RcSpartan, Rhodobacter virus RcTitan, Mycobacterium virus Anaya, Mycobacterium virus Angelica, Mycobacterium virus Crimd, Mycobacterium virus Fionnbarth, Mycobacterium virus Jaws, Mycobacterium virus Larva, Mycobacterium virus Macncheese, Mycobacterium virus Pixie, Mycobacterium virus TM4, Bacillus virus BMBtp2, Bacillus virus TP21, Geobacillus virus Tp84, Staphylococcus virus 47, Staphylococcus virus 3a, Staphylococcus virus 42e, Staphylococcus virus IPLA35, Staphylococcus virus phi12, Staphylococcus virus phiSLT, Mycobacterium virus 32HC, Rhodococcus virus RGL3, Paenibacillus virus Vegas, Gordonia virus Vendetta, Bacillus virus Wbeta, Mycobacterium virus Wildcat, Gordonia virus Twister6, Gordonia virus Wizard, Gordonia virus Hotorobo, Gordonia virus Monty, Gordonia virus Woes, Xanthomonas virus CP1, Xanthomonas virus OP1, Xanthomonas virus phiI7, Xanthomonas virus Xop411, Xanthomonas virus Xp10, Streptomyces virus TP1604, Streptomyces virus YDN12, Alphaproteobacteria virus phiJI001, Pseudomonas virus LKO4, Pseudomonas virus M6, Pseudomonas virus MP1412, Pseudomonas virus PAE1, Pseudomonas virus Yua, Pseudoalteromonas virus PM2, Pseudomonas virus phi6, Pseudomonas virus phi8, Pseudomonas virus phi12, Pseudomonas virus phi13, Pseudomonas virus phi2954, Pseudomonas virus phiNN, Pseudomonas virus phiYY, Vibrio virus fs1, Vibrio virus VGJ, Ralstonia virus RS603, Ralstonia virus RSM1, Ralstonia virus RSM3, Escherichia virus M13, Escherichia virus 122, Salmonella virus IKe, Acholeplasma virus L51, Vibrio virus fs2, Vibrio virus VFJ, Escherichia virus If1, Propionibacterium virus B5, Pseudomonas virus Pf1, Pseudomonas virus Pf3, Ralstonia virus PE226, Ralstonia virus RSS1, Spiroplasma virus SVTS2, Stenotrophomonas virus PSH1, Stenotrophomonas virus SMA6, Stenotrophomonas virus SMA7, Stenotrophomonas virus SMA9, Vibrio virus CTXphi, Vibrio virus KSF1, Vibrio virus VCY, Vibrio virus Vf33, Vibrio virus VfO3K6, Xanthomonas virus Cf1c, Spiroplasma virus C74, Spiroplasma virus R8A2B, Spiroplasma virus SkV1CR23x, Escherichia virus FI, Escherichia virus Qbeta, Escherichia virus BZ13, Escherichia virus MS2, Escherichia virus alpha3, Escherichia virus 1D21, Escherichia virus 1D32, Escherichia virus 1D62, Escherichia virus NC28, Escherichia virus NC29, Escherichia virus NC35, Escherichia virus phiK, Escherichia virus St1, Escherichia virus WA45, Escherichia virus G4, Escherichia virus ID52, Escherichia virus Talmos, Escherichia virus phiX174, Bdellovibrio virus MAC1, Bdellovibrio virus MH2K, Chlamydia virus Chp1, Chlamydia virus Chp2, Chlamydia virus CPAR39, Chlamydia virus CPG1, Spiroplasma virus SpV4, Acholeplasma virus L2, Pseudomonas virus PR4, Pseudomonas virus PRD1, Bacillus virus AP50, Bacillus virus Bam35, Bacillus virus GIL16, Bacillus virus Wip1, Escherichia virus phi80, Escherichia virus RB42, Escherichia virus T2, Escherichia virus T3, Escherichia virus T6, Escherichia virus VT2-Sa, Escherichia virus VT1-Sakai, Escherichia virus VT2-Sakai, Escherichia virus CP-933V, Escherichia virus P27, Escherichia virus Stx2phi-I, Escherichia virus Stx1phi, Escherichia virus Stx2phi-II, Escherichia virus CP-1639, based on the Escherichia virus BP-4795, Escherichia virus 86, Escherichia virus Min27, Escherichia virus 2851, Escherichia virus 1717, Escherichia virus YYZ-2008, Escherichia virus EC026_P06, Escherichia virus ECO103_P15, Escherichia virus ECO103_P12, Escherichia virus ECO111_P16, Escherichia virus ECO111_P11, Escherichia virus VT2phi_272, Escherichia virus TL-2011c, Escherichia virus P13374, Escherichia virus Sp5.

In one embodiment, the bacterial virus particles target *E. coli* and includes the capsid of a bacteriophage selected in the group consisting of BW73, B278, D6, D108, E, EI, E24, E41, F1-2, FI-4, FI-5, H18A, Ff18B, i, MM, Mu, 025, PhI-5, Pk, PSP3, PI, PID, P2, P4, SI, Wφ, φK13, φI, φ2, φ7, φ92, 7 A, 8φ, 9φ, 18, 28-1, 186, 299, HH-*Escherichia* (2), AB48, CM, C4, C16, DD-VI, E4, E7, E28, FII, FI3, H, HI, H3, H8, K3, M, N, ND-2, ND-3, ND4, ND-5, ND6, ND-7, Ox-I, Ox-2, Ox-3, Ox-4, Ox-5, Ox-6, PhI-I, RB42, RB43, RB49, RB69, S, Sal-I, Sal-2, Sal-3, Sal-4, Sal-5, Sal-6, TC23, TC45, TulI*-6, TulP-24, TulI*46, TulP-60, T2, T4, T6, T35, αI, 1, IA, 3, 3A, 3T+, 5φ, 9266Q, CFO103, HK620, J, K, KIF, m59, no. A, no. E, no. 3, no. 9, N4, sd, T3, T7, WPK, W31, ΔH, φC3888, φK3, φK7, φK12, φV-1, φ04-CF, φ05, φ06, φ07, φI, φI.2, φ20, φ95, φ263, φIO92, φI, φII, Ω8, 1, NN-*Escherichia* (1), Esc-7-11, AC30, CVX-5, CI, DDUP, ECI, EC2, E21, E29, FI, F26S, F27S, Hi, HK022, HK97, HK139, HK253, HK256, K7, ND-I, PA-2, q, S2, TI), T3C, T5, UC-I, w, β4, γ2, λ, φD326, φγ, φ06, φ7, φ10, φ80, χ, 2, 4, 4A, 6, 8A, 102, 150, 168, 174, 3000, AC6, AC7, AC28, AC43, AC50, AC57, AC81, AC95, HK243, KIO, ZG/3A, 5, 5A, 21EL, H19-J and 933H.

In some embodiment the vectors disclosed herein may be used in combination with prebiotics. Prebiotics include, but are not limited to, amino acids, biotin, fructo-oligosaccharide, galacto-oligosaccharides, hemicelluloses (e.g., arabinoxylan, xylan, xyloglucan, and glucomannan), inulin, chitin, lactulose, mannan oligosaccharides, oligofructose-enriched inulin, gums (e.g., guar gum, gum arabic and carrageenan), oligofructose, oligodextrose, tagatose, resistant maltodextrins (e.g., resistant starch), trans-galactooligosaccharide, pectins (e.g., xylogalactouronan, citrus pectin, apple pectin, and rhamnogalacturonan-I), dietary fibers (e.g., soy fiber, sugarbeet fiber, pea fiber, corn bran, and oat fiber) and xylooligosaccharides.

In other embodiment, the vectors disclosed herein may be used in combination with probiotics. Probiotics include, but are not limited to lactobacilli, bifidobacteria, streptococci, enterococci, propionibacteria, saccaromycetes, lactobacilli, bifidobacteria, or proteobacteria.

Screening Methods

The invention encompasses methods for screening for genetic modifications in bacteria. In one embodiment, the method comprises administering a vector designed to genetically modify at least one base of a DNA of interest in a gene of a naturally occurring bacteria, to a subject, subsequently collecting a bacterial sample from the subject, quantitating the level of bacteria containing a genetic modification in said at least one base of a DNA of interest in said bacterial sample. The method can further comprise quantitating the level of bacteria not containing a genetic modification in said at least one base of a DNA of interest.

In one embodiment, the proportion of endogenous modified vs non-modified bacteria is quantified. Preferred percentages of bacteria with the genetic modification are at least 20%, 30%, 40%, 50%, 60%, 70%, 80%, 90%, 95%, 97%, 98%, 99%, 99.9%, 99.99%, and 100%.

In one embodiment, the number of non-modified endogenous bacteria is quantified prior to administering a vector. The patient can also be pre-screened to determine the genetic signature of the strains the patient carries. This will allow selection of an appropriate capsid to deliver the therapeutic payload based on the genetic signature of the strains the patient carry.

In preferred embodiments, the vector is in a pharmaceutical and veterinary composition. Preferably the vector is a bacteriophage.

The vector can be administered to the subject by any administration technique known in the art, depending on the vector and the target bacteria's expected location in or on the subject.

The bacterial sample can be collected by any means known in the art, such as biopsy, blood draw, urine sample, stool sample, or oral/nasal swab, etc.

The level of bacteria containing or not containing a genetic modification in a base of a DNA of interest can be determined by any technique known to the skilled artisan, such as routine diagnostic procedures including ELISA, PCR, High Resolution Melting, and nucleic acid sequencing.

The invention encompasses methods for determining the efficiency of a vector at inducing genetic mutations in situ. In one embodiment, the method comprises administering a vector designed to genetically modify at least one base of a DNA of interest in a gene of a naturally occurring bacteria, to a subject, subsequently collecting a bacterial sample from the subject, quantitating the level of bacteria containing a genetic modification in said at least one base of a DNA of interest and quantitating the level of bacteria not containing a genetic modification in said at least one base of a DNA of interest in said bacterial sample.

In preferred embodiments, the vector is in a pharmaceutical and veterinary composition. Preferably the vector is a bacteriophage.

The vector can be administered to the subject by any administration technique known in the art, depending on the vector and the target bacteria's expected location in or on the subject.

The bacterial sample can be collected by any means known in the art, such as biopsy, blood draw, urine sample, stool sample, or oral/nasal swab, etc.

The level of bacteria containing or not containing a genetic modification in a base of a DNA of interest can be determined by any technique known to the skilled artisan, such as routine diagnostic procedures including ELISA, PCR, High Resolution Melting, and nucleic acid sequencing.

The invention encompasses methods for determining the effect of a genetic mutation on bacterial growth. In one embodiment, the method comprises administering a vector designed to genetically modify at least one base of a DNA of interest in a gene of a naturally occurring bacteria, to a subject, subsequently collecting at least two sequential bacterial samples from the subject, quantitating the level of bacteria containing a genetic modification in said at least one base of a DNA of interest and quantitating the level of bacteria not containing a genetic modification in said at least one base of a DNA of interest in said bacterial samples.

In preferred embodiments, the vector is in a pharmaceutical and veterinary composition. Preferably the vector is a bacteriophage.

The vector can be administered to the subject by any administration technique known in the art, depending on the vector and the target bacteria's expected location in or on the subject.

The bacterial samples can be collected by any means known in the art, such as biopsy, blood draw, urine sample, stool sample, or oral/nasal swab, etc. The samples can be collected at any sequential time points. Preferably, the time between these collections is at least 3, 6, 12, 24, 48, 72, 96 hrs or 7, 14, 30, 60, 120, or 365 days.

The level of bacteria containing or not containing a genetic modification in a base of a DNA of interest can be determined by any technique known to the skilled artisan, such as routine diagnostic procedures including ELISA, PCR, High Resolution Melting, and nucleic acid sequencing.

All of the screening methods of the invention can use any of the vectors and enzymes/systems of the invention to screen for any of the genetic modification of the invention.

All of the screening methods of the invention can further include a step of comparing the level of bacteria containing a genetic modification in a base of a DNA of interest with the level of bacteria not containing a genetic modification the base of a DNA of interest in a bacterial sample.

All of the screening methods of the invention can further include a step of contacting the vector with bacteria in liquid or solid culture and quantifying the level of bacteria containing a genetic modification in said at least one base of a DNA of interest in said bacterial sample. The method can further comprise quantitating the level of bacteria not containing a genetic modification in said at least one base of a DNA of interest.

In one embodiment, the method comprises providing a vector designed to genetically modify at least one base of a DNA of interest in a gene of a naturally occurring bacteria. The method can further comprise contacting the vector with bacteria in liquid or solid culture and quantitating the level of bacteria containing a genetic modification in said at least one base of a DNA of interest in said bacterial sample. The method can further comprise quantitating the level of bacteria not containing a genetic modification in said at least one base of a DNA of interest. The levels of bacteria containing a genetic modification in a base of a DNA of interest can be compared with the level of bacteria not containing a genetic modification the base of a DNA of interest over time in the culture. Preferably, the time between these comparisons is at least 1, 2, 3, 4, 5, 6, 12, 24, 48, 72, or 96 hours.

Pharmaceutical and Veterinary Compositions and In Situ Administration Methods

The invention encompasses pharmaceutical and veterinary compositions comprising the vectors of the invention.

The invention encompasses in situ administration of the pharmaceutical or veterinary composition to the bacteria in a subject. Any method known to the skilled artisan can be used to contact the vector with the bacterial target in situ.

The pharmaceutical or veterinary composition according to the invention may further comprise a pharmaceutically acceptable vehicle. A solid pharmaceutically acceptable vehicle may include one or more substances which may also act as flavoring agents, lubricants, solubilisers, suspending agents, dyes, fillers, glidants, compression aids, inert binders, sweeteners, preservatives, dyes, coatings, or tablet-disintegrating agents. Suitable solid vehicles include, for example calcium phosphate, magnesium stearate, talc, sugars, lactose, dextrin, starch, gelatin, cellulose, polyvinylpyrrolidone, low melting waxes and ion exchange resins.

The pharmaceutical or veterinary composition may be prepared as a sterile solid composition that may be suspended at the time of administration using sterile water, saline, or other appropriate sterile injectable medium. The pharmaceutical or veterinary compositions of the invention may be administered orally in the form of a sterile solution or suspension containing other solutes or suspending agents (for example, enough saline or glucose to make the solution isotonic), bile salts, acacia, gelatin, sorbitan monoleate, polysorbate 80 (oleate esters of sorbitol and its anhydrides copolymerized with ethylene oxide) and the like. The particles according to the invention can also be administered orally either in liquid or solid composition form. Compositions suitable for oral administration include solid forms, such as pills, capsules, granules, tablets, and powders, and liquid forms, such as solutions, syrups, elixirs, and suspensions. Forms useful for enteral administration include sterile solutions, emulsions, and suspensions.

The bacterial virus particles according to the invention may be dissolved or suspended in a pharmaceutically acceptable liquid vehicle such as water, an organic solvent, a mixture of both or pharmaceutically acceptable oils or fats. The liquid vehicle can contain other suitable pharmaceutical additives such as solubilisers, emulsifiers, buffers, preservatives, sweeteners, flavouring agents, suspending agents, thickening agents, colours, viscosity regulators, stabilizers or osmo-regulators. Suitable examples of liquid vehicles for oral and enteral administration include water (partially containing additives as above, e.g. cellulose derivatives, preferably sodium carboxymethyl cellulose solution), alcohols (including monohydric alcohols and polyhydric alcohols, e.g. glycols) and their derivatives, and oils (e.g. fractionated coconut oil and *arachis* oil). For parenteral administration, the vehicle can also be an oily ester such as ethyl oleate and isopropyl myristate. Sterile liquid vehicles are useful in sterile liquid form compositions for enteral administration. The liquid vehicle for pressurized compositions can be a halogenated hydrocarbon or other pharmaceutically acceptable propellant.

In some embodiments, the invention encompasses pharmaceutical or veterinary composition formulated for delayed or gradual enteric release. In preferred embodiments, formulations or pharmaceutical preparations of the invention are formulated for delivery of the vector into the distal small bowel and/or the colon. The formulation can allow the vector to pass through stomach acid and pancreatic enzymes and bile, and reach undamaged to be viable in the distal small bowel and colon.

In some embodiments, the pharmaceutical or veterinary composition is micro-encapsulated, formed into tablets and/or placed into capsules, preferably enteric-coated capsules.

In some embodiments, the pharmaceutical or veterinary compositions are formulated for delayed or gradual enteric release, using cellulose acetate (CA) and polyethylene glycol (PEG). In some embodiments, the pharmaceutical or veterinary compositions are formulated for delayed or gradual enteric release using a hydroxypropylmethylcellulose (HPMC), a microcrystalline cellulose (MCC) and magnesium stearate. the pharmaceutical or veterinary compositions are formulated for delayed or gradual enteric release using e.g., a poly(meth)acrylate, e.g. a methacrylic acid copolymer B, a methyl methacrylate and/or a methacrylic acid ester, or a polyvinylpyrrolidone (PVP).

In some embodiments, the pharmaceutical or veterinary compositions are formulated for delayed or gradual enteric release using a release-retarding matrix material such as: an acrylic polymer, a cellulose, a wax, a fatty acid, shellac, zein, hydrogenated vegetable oil, hydrogenated castor oil, polyvinylpyrrolidone, a vinyl acetate copolymer, a vinyl alcohol copolymer, polyethylene oxide, an acrylic acid and methacrylic acid copolymer, a methyl methacrylate copolymer, an ethoxyethyl methacrylate polymer, a cyanoethyl methacrylate polymer, an aminoalkyl methacrylate copolymer, a poly(acrylic acid), a poly(methacrylic acid), a methacrylic acid alkylamide copolymer, a poly(methyl methacrylate), a poly(methacrylic acid anhydride), a methyl methacrylate polymer, a polymethacrylate, a poly(methyl methacrylate) copolymer, a polyacrylamide, an aminoalkyl methacrylate copolymer, a glycidyl methacrylate copolymer, a methyl cellulose, an ethylcellulose, a carboxymethylcellulose, a hydroxypropylmethylcellulose, a hydroxymethyl cellulose, a hydroxyethyl cellulose, a hydroxypropyl cellulose, a crosslinked sodium carboxymethylcellulose, a crosslinked hydroxypropylcellulose, a natural wax, a synthetic wax, a fatty alcohol, a fatty acid, a fatty acid ester, a fatty acid glyceride, a hydrogenated fat, a hydrocarbon wax, stearic acid, stearyl alcohol, beeswax, glycowax, castor wax, carnauba wax, a polylactic acid, polyglycolic acid, a co-polymer of lactic and glycolic acid, carboxymethyl starch, potassium methacrylate/divinylbenzene copolymer, crosslinked polyvinylpyrrolidone, polyvinylalcohols, polyvinyl-alcohol copolymers, polyethylene glycols, non-crosslinked polyvinylpyrrolidone, polyvinyl acetates, polyvinylacetate copolymers or any combination thereof.

In some embodiments, the pharmaceutical or veterinary compositions are formulated for delayed or gradual enteric release as described in U.S. Pat. App. Pub. 20110218216, which describes an extended release pharmaceutical composition for oral administration, and uses a hydrophilic polymer, a hydrophobic material and a hydrophobic polymer or a mixture thereof, with a microenvironment pH modifier. The hydrophobic polymer can be ethylcellulose, cellulose acetate, cellulose propionate, cellulose butyrate, methacrylic acid-acrylic acid copolymers or a mixture thereof. The hydrophilic polymer can be polyvinylpyrrolidone, hydroxypropylcellulose, methylcellulose, hydroxypropylmethyl cellulose, polyethylene oxide, acrylic acid copolymers or a mixture thereof. The hydrophobic material can be a hydrogenated vegetable oil, hydrogenated castor oil, carnauba wax, candellia wax, beeswax, paraffin wax, stearic acid, glyceryl behenate, cetyl alcohol, cetostearyl alcohol or and a mixture thereof. The microenvironment pH modifier can be an inorganic acid, an amino acid, an organic acid or a mixture thereof. Alternatively, the microenvironment pH modifier can be lauric acid, myristic acid, acetic acid, benzoic acid, palmitic acid, stearic acid, oxalic acid, malonic acid, succinic acid, adipic acid, sebacic acid, fumaric acid, maleic acid; glycolic acid, lactic acid, malic acid, tartaric acid, citric acid, sodium dihydrogen citrate, gluconic acid, a salicylic acid, tosylic acid, mesylic acid or malic acid or a mixture thereof.

In some embodiments, the pharmaceutical or veterinary compositions are a powder that can be included into a tablet or a suppository. In alternative embodiments, a formulation or pharmaceutical preparation of the invention can be a 'powder for reconstitution' as a liquid to be drunk or otherwise administered.

In some embodiments, the pharmaceutical or veterinary compositions can be administered in a cream, gel, lotion, liquid, feed, or aerosol spray. In some embodiments, a bacteriophage is immobilized to a solid surface using any substance known in the art and any technology known in the art, for example, but not limited to immobilization of bacteriophages onto polymeric beads using technology as outlined in U.S. Pat. No. 7,482,115, which is incorporated herein by reference. Phages may be immobilized onto appropriately sized polymeric beads so that the coated beads may be added to aerosols, creams, gels or liquids. The size of the polymeric beads may be from about 0.1 µm to 500 µm, for example 50 pm to 100 µm. The coated polymeric beads may be incorporated into animal feed, including pelleted feed and feed in any other format, incorporated into any other edible device used to present phage to the animals, added to water offered to animals in a bowl, presented to animals through water feeding systems. In some embodiments, the compositions are used for treatment of surface wounds and other surface infections using creams, gels, aerosol sprays and the like.

In some embodiments, the pharmaceutical or veterinary compositions can be administered by inhalation, in the form of a suppository or pessary, topically (e.g., in the form of a lotion, solution, cream, ointment or dusting powder), epi- or transdermally (e.g., by use of a skin patch), orally (e.g., as a tablet, which may contain excipients such as starch or lactose), as a capsule, ovule, elixirs, solutions, or suspensions (each optionally containing flavoring, coloring agents and/or excipients), or they can be injected parenterally (e.g., intravenously, intramuscularly or subcutaneously). For parenteral administration, the compositions may be used in the form of a sterile aqueous solution which may contain other substances, for example enough salts or monosaccharides to make the solution isotonic with blood. For buccal or sublingual administration the compositions may be administered in the form of tablets or lozenges which can be formulated in a conventional manner. In a preferred embodiment, a bacteriophage and/or polypeptide of the present invention is administered topically, either as a single agent, or in combination with other antibiotic treatments, as described herein or known in the art.

In some embodiments, the pharmaceutical or veterinary compositions can also be dermally or transdermally administered. For topical application to the skin, the pharmaceutical or veterinary composition can be combined with one or a combination of carriers, which can include but are not limited to, an aqueous liquid, an alcohol base liquid, a water soluble gel, a lotion, an ointment, a nonaqueous liquid base, a mineral oil base, a blend of mineral oil and petrolatum, lanolin, liposomes, proteins carriers such as serum albumin or gelatin, powdered cellulose carmel, and combinations thereof. A topical mode of delivery may include a smear, a spray, a bandage, a time-release patch, a liquid-absorbed wipe, and combinations thereof. The pharmaceutical or veterinary composition can be applied to a patch, wipe, bandage, etc., either directly or in a carrier(s). The patches, wipes, bandages, etc., may be damp or dry, wherein the phage and/or polypeptide (e.g., a lysin) is in a lyophilized form on the patch. The carriers of topical compositions may comprise semi-solid and gel-like vehicles that include a polymer thickener, water, preservatives, active surfactants, or emulsifiers, antioxidants, sun screens, and a solvent or mixed solvent system. U.S. Pat. No. 5,863,560 discloses a number of different carrier combinations that can aid in the exposure of skin to a medicament, and its contents are incorporated herein.

For intranasal or administration by inhalation, the pharmaceutical or veterinary composition is conveniently delivered in the form of a dry powder inhaler or an aerosol spray presentation from a pressurized container, pump, spray, or nebuliser with the use of a suitable propellant, e.g., dichlorodifluoromethane, trichlorofluoromethane, dichlorotetrafluoroethane, a hydrofluoroalkane such as 1,1,1,2-tetrafluoroethane or 1,1,1,2,3,3,3-heptafluoropropane, carbon dioxide, or other suitable gas. In the case of a pressurized aerosol, the dosage unit may be determined by providing a valve to deliver a metered amount. The pressurized container, pump, spray, or nebuliser may contain a solution or suspension of the active compound, e.g., using a mixture of ethanol and the propellant as the solvent, which may additionally contain a lubricant, e.g., sorbitan trioleate. Capsules and cartridges (made, for example, from gelatin) for use in an inhaler or insufflator may be formulated to contain a powder mix of the bacteriophage and/or polypeptide of the invention and a suitable powder base such as lactose or starch.

For administration in the form of a suppository or pessary, the pharmaceutical or veterinary composition can be applied topically in the form of a gel, hydrogel, lotion, solution, cream, ointment, or dusting powder. Compositions of the invention may also be administered by the ocular route. For ophthalmic use, the compositions of the invention can be formulated as micronized suspensions in isotonic, pH adjusted, sterile saline, or, preferably, as solutions in isotonic, pH adjusted, sterile saline, optionally in combination with a preservative such as a benzylalkonium chloride. Alternatively, they may be formulated in an ointment such as petrolatum.

Dosages and desired drug concentrations of the pharmaceutical and veterinary composition compositions of the present invention may vary depending on the particular use. The determination of the appropriate dosage or route of administration is within the skill of an ordinary physician. Animal experiments can provide reliable guidance for the determination of effective doses in human therapy.

For transdermal administration, the pharmaceutical or veterinary composition can be formulated into ointment, cream or gel form and appropriate penetrants or detergents could be used to facilitate permeation, such as dimethyl sulfoxide, dimethylacetamide and dimethylformamide.

For transmucosal administration, nasal sprays, rectal or vaginal suppositories can be used. The active compounds can be incorporated into any of the known suppository bases by methods known in the art. Examples of such bases include cocoa butter, polyethylene glycols (carbowaxes), polyethylene sorbitan monostearate, and mixtures of these with other compatible materials to modify the melting point or dissolution rate.

Disease Treatment

The invention encompasses the treatment of diseases and metabolic disorders caused by bacteria. The diseases or disorders caused by bacteria may be selected from the group consisting of skin chronic inflammation such as acne (acne vulgaris), progressive macular hypomelanosis, abdominal cramps, acute epiglottitis, arthritis, bacteraemia, bloody diarrhea, botulism, Brucellosis, brain abscess, cardiomyopathy, chancroid venereal disease, *Chlamydia*, Crohn's disease, conjunctivitis, cholecystitis, colorectal cancer, polyposis, dysbiosis, Lyme disease, diarrhea, diphtheria, duodenal ulcers, endocarditis, erysipelothricosis, enteric fever, fever, glomerulonephritis, gastroenteritis, gastric ulcers, Guillain-Barre syndrome tetanus, gonorrhoea, gingivitis, inflammatory bowel diseases, irritable bowel syndrome, leptospirosis, leprosy, listeriosis, tuberculosis, Lady Widermere syndrome, Legionaire's disease, meningitis, mucopurulent conjunctivitis, multi-drug resistant bacterial infections, multi-drug resistant bacterial carriage, myocarditis, myonecrosis-gas gangrene, *Mycobacterium avium* complex, neonatal necrotizing enterocolitis, nocardiosis, nosocomial infection, otitis, periodontitis, phalyngitis, pneumonia, peritonitis, purpuric fever, Rocky Mountain spotted fever, shigellosis, syphilis, sinusitis, sigmoiditis, septicaemia, subcutaneous abscesses, tularaemia, tracheobronchitis, tonsillitis, typhoid fever, ulcerative colitis, urinary infection, whooping cough, Non-alcoholic Fatty Liver Disease (NAFLD), Nonalcoholic steatohepatitis (NASH).

The infection caused by bacteria may be selected from the group consisting of infections, preferably intestinal infections such as esophagitis, gastritis, enteritis, colitis, sigmoiditis, rectitis, and peritonitis, urinary tract infections, vaginal infections, female upper genital tract infections such as salpingitis, endometritis, oophoritis, myometritis, parametritis and infection in the pelvic peritoneum, respiratory tract infections such as pneumonia, intra-amniotic infections, odontogenic infections, endodontic infections, fibrosis, meningitis, bloodstream infections, nosocomial infection such as catheter-related infections, hospital acquired pneumonia, post-partum infection, hospital acquired gastroenteritis, hospital acquired urinary tract infections, or a combination thereof. Preferably, the infection according to the invention is caused by a bacterium presenting an antibiotic resistance. In a particular embodiment, the infection is caused by a bacterium as listed above in the targeted bacteria.

The disclosure also concerns a pharmaceutical or veterinary composition of the invention for the treatment of a metabolic disorder including, for example, obesity, type 2 diabetes and nonalcoholic fatty liver disease. Indeed, emerging evidence indicates that these disorders are characterized by alterations in the intestinal microbiota composition and its metabolites (Tilg et al., Nature Reviews Immunology, volume 20, pages 40-54, 2020). The pharmaceutical or veterinary composition may thus be used to deliver in some intestinal bacteria a nucleic acid of interest which can alter the intestinal microbiota composition or its metabolites (e.g. by inducing expression, overexpression or secretion of some molecules by said bacteria, for example molecules having a beneficial role on metabolic inflammation). The disclosure also concerns the use of a pharmaceutical or veterinary composition of the invention for the manufacture of a medicament for the treatment of a metabolic disorder including, for example, obesity, type 2 diabetes and nonalcoholic fatty liver disease. It also relates to a method for treating a metabolic disorder including, for example, obesity, type 2 diabetes and nonalcoholic fatty liver disease, comprising administering to a subject having a metabolic disorder in need of treatment the provided pharmaceutical or veterinary composition, in particular a therapeutically effective amount of the provided pharmaceutical or veterinary composition.

In a particular embodiment, the invention concerns a pharmaceutical or veterinary composition for use in the treatment of pathologies involving bacteria of the human microbiome, such as inflammatory and auto-immune diseases, cancers, infections or brain disorders. Indeed, some bacteria of the microbiome, without triggering any infection, can secrete molecules that will induce and/or enhance inflammatory or auto-immune diseases or cancer development. More specifically, the present invention relates also to modulating microbiome composition to improve the efficacy of immunotherapies based, for example, on CAR-T (Chimeric Antigen Receptor T) cells, TIL (Tumor Infiltrating Lymphocytes) and Tregs (Regulatory T cells) also known as suppressor T cells. Modulation of the microbiome composition to improve the efficacy of immunotherapies may also include the use of immune checkpoint inhibitors well known in the art such as, without limitation, PD-1 (programmed cell death protein 1) inhibitor, PD-L1 (programmed death ligand 1) inhibitor and CTLA-4 (cytotoxic T lymphocyte associated protein 4).

Some bacteria of the microbiome can also secrete molecules that will affect the brain.

Therefore, a further object of the invention is a method, in particular a non-therapeutic method, for controlling the microbiome of a subject, comprising administering an effective amount of the pharmaceutical composition as disclosed herein in said subject. A further object of the invention is the pharmaceutical composition of the invention further use for controlling the microbiome of a subject.

In a particular embodiment, the invention also relates to a method for personalized treatment for an individual in need of treatment for a bacterial infection comprising: i) obtaining a biological sample from the individual and determining a group of bacterial DNA sequences from the sample; ii) based on the determining of the sequences, identifying one or more pathogenic bacterial strains or species that were in the sample; and iii) administering to the individual a pharmaceutical composition according to the invention capable of recognizing each pathogenic bacterial strain or species identified in the sample and to deliver the packaged payload. The present invention also concerns a pharmaceutical composition of the invention for use in a method for personalized treatment for an individual in need of treatment for a bacterial infection, said method comprising: i) obtaining a biological sample from the individual and determining a group of bacterial DNA sequences from the sample; ii) based on the determining of the sequences, identifying one or more pathogenic bacterial strains or species that were in the sample; and wherein the pharmaceutical composition is capable of recognizing each pathogenic bacterial strain or species identified in the sample and to deliver the packaged plasmid.

Preferably, the biological sample comprises pathological and non-pathological bacterial species, and subsequent to administering the pharmaceutical or veterinary composition according to the invention to the individual, the amount of pathogenic bacteria on or in the individual are reduced, but the amount of non-pathogenic bacteria is not reduced.

In another particular embodiment, the invention concerns a pharmaceutical or veterinary composition according to the invention for use in order to improve the effectiveness of drugs. Indeed, some bacteria of the microbiome, without being pathogenic by themselves, are known to be able to metabolize drugs and to modify them in ineffective or harmful molecules.

In another particular embodiment, the invention concerns the in-situ bacterial production of any compound of interest, including therapeutic compound such as prophylactic and therapeutic vaccine for mammals. The compound of interest can be produced inside the targeted bacteria, secreted from the targeted bacteria or expressed on the surface of the targeted bacteria. In a more particular embodiment, an antigen is expressed on the surface of the targeted bacteria for prophylactic and/or therapeutic vaccination.

Method for Counter-Selection In Situ

In a particular embodiment, the vector encodes a DNA modifying enzyme, in particular a programmed nuclease, that can discriminate between targeted bacteria that have been genetically modified in situ and targeted bacteria in which the modification has not occurred, leading to the specific killing of the targeted bacteria in which the modification has not occurred.

In a particular embodiment, the nuclease can be a RNA-guided nuclease.

In a particular embodiment, the design of the vector increases the chances that the killing effect mediated by said programmed nuclease is delayed, thereby providing enough time for the target DNA sequence to be edited by the base-editing or prime-editing enzyme/system.

The invention also provides compositions and methods to ensure a robust alteration of all targeted bacteria within a microbiome population, thanks to the delivery of a nuclease programmed to discriminate between targeted bacteria that have been genetically modified in situ and targeted bacteria in which the modification has not occurred, leading to the specific killing of those in which the modification has not occurred. In a particular embodiment, the vector of the invention is thus used in combination with a nucleic acid encoding a nuclease programmed to discriminate between targeted bacteria that have been genetically modified in situ and targeted bacteria in which the modification has not occurred, leading to the specific killing of those in which the modification has not occurred. In a particular embodiment, the delivery of such a programmed nuclease is either on the same vector as the one carrying the base-editing nuclease, or on a different vector. In a particular embodiment, the delivery of such programmed nuclease is implemented either simultaneously or after the vector encoding the base-editing nuclease. If delivered simultaneously, the vector can be engineered to have a delayed targeting process for the programmed nuclease leading to a double strand break.

Non-Therapeutic Uses

The present invention also relates to a non-therapeutic use of the bacterial delivery particles of the invention. For instance, the non-therapeutic use can be a cosmetic use or a use for improving the well-being of a subject, in particular a subject who does not suffer from a disease. Accordingly, the present invention also relates to a cosmetic composition or a non-therapeutic composition comprising the bacterial delivery particles of the invention.

Subject, Regimen and Administration

The subject according to the invention is an animal, preferably a mammal, even more preferably a human. However, the term "subject" can also refer to non-human animals, in particular mammals such as dogs, cats, horses, cows, pigs, sheep, donkeys, rabbits, ferrets, gerbils, hamsters, chinchillas, rats, mice, guinea pigs and non-human primates, among others, or non-mammals such as poultry, that are in need of treatment.

The human subject according to the invention may be a human at the prenatal stage, a new-born, a child, an infant, an adolescent or an adult at any age.

In a preferred embodiment, the subject has been diagnosed with, or is at risk of developing an infection, a disorder and/or a disease preferably due to a bacterium. Diagnostic methods of such infection, disorder and/or disease are well known by the man skilled in the art.

In a particular embodiment, the infection, disorder and/or disease presents a resistance to treatment, preferably the infection, disorder or disease presents an antibiotic resistance.

In a particular embodiment, the subject has never received any treatment prior to the administration of the delivery vehicles according to the invention, preferably a vector according to the invention, particularly a payload packaged into a delivery vehicle according to the invention, preferably a packaged plasmid or phagemid into a bacterial virus particle according to the invention, or of a pharmaceutical or veterinary composition according to the invention.

In a particular embodiment, the subject has already received at least one line of treatment, preferably several lines of treatment, prior to the administration of the delivery vehicles according to the invention, preferably a vector according to the invention, particularly a payload packaged into a delivery vehicle according to the invention, preferably a packaged plasmid or phagemid into a bacterial virus particle according to the invention, or of a pharmaceutical or veterinary composition according to the invention.

Preferably, the treatment is administered regularly, preferably between every day and every month, more preferably between every day and every two weeks, more preferably between every day and every week, even more preferably the treatment is administered every day. In a particular embodiment, the treatment is administered several times a day, preferably 2 or 3 times a day, even more preferably 3 times a day.

The duration of treatment with delivery vehicles according to the invention, preferably a vector according to the invention, particularly a payload packaged into a delivery vehicle according to the invention, preferably a packaged plasmid or phagemid into a bacterial virus particle according to the invention, or with a pharmaceutical or veterinary composition according to the invention, is preferably comprised between 1 day and 20 weeks, more preferably between 1 day and 10 weeks, still more preferably between 1 day and 4 weeks, even more preferably between 1 day and 2 weeks. In a particular embodiment, the duration of the treatment is about 1 week. Alternatively, the treatment may last as long as the infection, disorder and/or disease persists.

The form of the pharmaceutical or veterinary compositions, the route of administration and the dose of administration of delivery vehicles according to the invention, preferably of a vector according to the invention, particularly of a payload packaged into a delivery vehicle according to the invention, preferably of a packaged plasmid or phagemid into a bacterial virus particle according to the invention, or of a pharmaceutical or veterinary composition according to the invention can be adjusted by the man skilled in the art according to the type and severity of the infection (e.g. depending on the bacteria species involved in the disease, disorder and/or infection and its localization in the patient's or subject's body), and to the patient or subject, in particular its age, weight, sex, and general physical condition.

Particularly, the amount of delivery vehicles according to the invention, preferably a vector according to the invention, particularly a payload packaged into a delivery vehicle according to the invention, preferably a packaged plasmid or phagemid into a bacterial virus particle according to the invention, or of a pharmaceutical or veterinary composition according to the invention, to be administered has to be determined by standard procedure well known by those of ordinary skills in the art. Physiological data of the patient or subject (e.g. age, size, and weight) and the routes of administration have to be taken into account to determine the appropriate dosage, so as a therapeutically effective amount will be administered to the patient or subject.

For example, the total amount of delivery vehicles, particularly a payload packaged into a delivery vehicle according to the invention, preferably a plasmid or phagemid packaged into a bacterial virus particle according to the invention, for each administration is comprised between $10^{14}$ and $10^{15}$ delivery vehicles.

The present invention further concerns the following embodiments:

1. A method of modifying a naturally occurring bacteria in situ comprising:

genetically modifying a DNA sequence in the naturally occurring bacteria in situ without introducing a double strand break in the DNA sequence, wherein said genetic modification does not lead to the death of bacteria.

2. The method according to embodiment 1, comprising contacting said naturally occurring bacteria with a vector.

3. The method according to embodiment 1, comprising contacting said naturally occurring bacteria with a vector located inside a delivery vehicle.

4. The method according to embodiment 3, wherein said vector located inside a delivery vehicle is a phagemid.

5. The method according to embodiment 1, comprising transducing said naturally occurring bacteria with a packaged phagemid.

6. The method according to embodiment 4 or 5, wherein said phagemid comprises a nucleic acid sequence encoding a dCas9 (dead-Cas9) or nCas9 (nickase Cas9).

7. The method according to embodiment 4 or 5, wherein said phagemid comprises a nucleic acid sequence encoding a dCas9 and a deaminase domain, or a nCas9 and deaminase domain.

8. The method according to embodiment 4 or 5, wherein said phagemid comprises a nucleic acid sequence encoding a dCas9 and a reverse transcriptase domain, or a nCas9 and a reverse transcriptase domain.

9. The method according to any of embodiments 2 to 8, wherein the vector or phagemid further comprises a conditional origin of replication which is inactive in the targeted naturally occurring bacteria but is active in a donor bacterial cell.

10. The method according to embodiment 9, wherein said conditional origin of replication is an origin of replication, the replication of which depends upon the presence of a given protein, peptid, nucleic acid, RNA, molecule or any combination thereof.

11. The method according to embodiment 10, wherein said conditional origin of replication is active in said donor bacterial cell because said donor bacterial cell expresses said given protein, peptid, nucleic acid, RNA, molecule or any combination thereof.

12. The method according to any of embodiments 9-11, wherein said conditional origin of replication is an origin of replication derived from phage-inducible chromosomal islands (PICIs).

13. The method according to embodiment 12, wherein said conditional origin of replication is active in said donor bacterial cell because said donor bacterial cell expresses a rep protein, in particular a primase-helicase.

14. The method according to embodiment 12 or 13, wherein said conditional origin of replication is derived from the origin of replication from the PICI of the *Escherichia coli* strain CFT073.

15. The method according to embodiment 14, wherein said conditional origin of replication comprises or consists of the sequence SEQ ID NO: 7 or SEQ ID NO: 8.

16. The method according to any of embodiments 1-15, wherein said genetic modification is a point mutation.

17. The method according to any of embodiments 1-16, wherein said genetic modification is a point mutation leading to gene disruption.

18. The method according to any of embodiments 1-17, wherein the bacteria with the genetic modification does not have a reduced in vivo growth rate as compared to the same bacteria without the genetic modification.

19. The method according to any of embodiments 1-18, wherein the genetic modification is in a bacterial toxin gene.

20. The method according to embodiment 19, comprising a genetic modification of the ClbP gene in pks+ *E. coli* that results in a single-amino acid mutation and the inactivation of the genotoxic activity of Colibactin toxin, but maintains the antagonistic activity.

21. The method according to embodiment 20, comprising a genetic modification at S95 or K98 of the ClbP gene.

22. The method according to embodiment 21, comprising a genetic modification of S95A, S95R or K98T.

23. The method according to any of embodiments 1-18, wherein the genetic modification is in the *Bacteroides faecis* or *Bacteroides thetaiotaomicron* beta-galactosidase gene.

24. The method according to embodiment 16, wherein the *Bacteroides faecis* or *Bacteroides thetaiotaomicron* beta-galactosidase protein with the genetic modification shows lower homology with human MYH6 cardiac peptide as compared to the *Bacteroides faecis* or *Bacteroides thetaiotaomicron* beta-galactosidase protein without the genetic modification.

25. The method according to any of embodiments 1-18, wherein the genetic modification is in *Propionibacterium propionicum* Ro60 orthologs.

26. The method according to embodiment 25, wherein the genetic modification is in at least one *Propionibacterium propionicum* Ro60 ortholog epitope leading to weaker or no recognition by the human immune system.

27. The method according to any of embodiments 1-26, comprising genetically modifying at least one gene in the naturally occurring bacteria in situ in a human.

28. A method of modulating host-microbiome interaction by genetically modifying naturally occurring bacteria in situ wherein said naturally occurring bacteria is involved in microbiome associated disorder or disease comprising:

genetically modifying a DNA sequence responsible for the microbiome associated disorder or disease in the naturally occurring bacteria in situ without introducing a double strand break in the DNA sequence, wherein said genetic modification reduces the effects of the microbiome associated disorder or disease, and wherein said genetic modification does not lead to the death of bacteria.

29. The method according to embodiment 28, wherein the bacteria with the genetic modification does not have a reduced in vivo growth rate as compared to the same bacteria without the genetic modification.

30. A method to prevent or intervene in the course of an auto-immune disease/reaction in a predisposed host by modifying the immunogenic profile of a bacterial population of the host microbiome, comprising:

contacting the bacterial population with a vector that generates a genetic modification in a DNA sequence coding for an immunogenic component expressed or secreted by the bacteria in at least some of the bacteria of said population without introducing a double strand break in the DNA sequence, wherein the genetic modification of the gene coding for the immunogenic component results in loss of its immunogenic component;

wherein genetic modification does not lead to the direct death of the bacteria.

31. The method according to embodiment 30, wherein the bacteria with the genetic modification does not have a reduced in vivo growth rate as compared to the same bacteria without the genetic modification.

32. The method according to embodiment 30 comprising contacting said bacteria with a phagemid encoding an enzyme that modifies the genome of said bacteria.

33. The method according to embodiment 30, comprising contacting said bacteria with a phagemid encoding an enzyme that is a base-editor.

34. The method according to embodiment 30, comprising contacting said bacteria with a phagemid encoding an enzyme that is a prime-editor.

35. The method according to any of embodiments 28 or 30, wherein the genetic modification is a point mutation that results in a change of amino-acid in a mimic peptide and renders the mimic peptide not immunogenic and/or not recognized by the immune system.

36. The method according to embodiment 28, wherein the genetic modification results in a change of sugar profile on the bacterial membrane.

37. The method according to embodiment 28, wherein the genetic modification results in a change of amino acid in a protein sequence that in turn results in a change of sugar profile on the bacterial membrane.

38. The method according to embodiment 28, wherein the genetic modification results in a change of lipid profile on the bacterial membrane.

39. The method according to embodiment 28, wherein the genetic modification results in a change of amino acid in a protein sequence that in turn results in a change of lipid profile on the bacterial membrane.

40. The method according to any of embodiments 1-30, wherein the genetic modification renders a catalytic site inactive.

41. The method according to any of embodiments 1-30, wherein the genetic modification renders a binding site with a human cell receptor non-functional.

42. The method according to any of embodiments 1-30, wherein the genetic modification renders the bacteria more sensitive to detection by human immune cells.

43. A method for screening for genetic modifications in bacteria comprising:
administering, to a subject, a vector designed to genetically modify at least one base of a DNA sequence of interest in a gene of a naturally occurring bacteria without introducing a double strand break in the DNA sequence,
subsequently collecting a bacterial sample from the subject, and
quantitating the level of bacteria containing a genetic modification in said at least one base of a DNA sequence of interest in said bacterial sample.

44. The method according to embodiment 43, further comprising quantitating the level of bacteria not containing a genetic modification in said at least one base of a DNA sequence of interest.

45. A method for determining the efficiency of a vector at inducing genetic mutations in situ comprising:
administering, to a subject, a vector designed to genetically modify at least one base of a DNA sequence of interest in a gene of a naturally occurring bacteria without introducing a double strand break in the DNA sequence,
subsequently collecting a bacterial sample from the subject,
quantitating the level of bacteria containing a genetic modification in said at least one base of a DNA sequence of interest, and quantitating the level of bacteria not containing a genetic modification in said at least one base of a DNA sequence of interest in said bacterial sample.

46. A method for determining the effect of a genetic mutation on bacterial growth comprising:
administering, to a subject, a vector designed to genetically modify at least one base of a DNA sequence of interest in a gene of a naturally occurring bacteria, without introducing a double strand break in the DNA sequence,
subsequently collecting at least two sequential bacterial samples from the subject,
quantitating the level of bacteria containing a genetic modification in said at least one base of a DNA sequence of interest and quantitating the level of bacteria not containing a genetic modification in said at least one base of a DNA sequence of interest in said bacterial samples.

47. The method according to any of embodiments 43 to 46, comprising a genetic modification of the ClbP gene in pks+ *E. coli* that results in a single-amino acid mutation and the inactivation of the genotoxic activity of Colibactin toxin, but maintains the antagonistic activity.

48. An engineered bacteriophage for modifying a naturally occurring bacteria in situ comprising a nucleic acid encoding a gene editing enzyme/system for transformation of a target bacteria in a mixed bacterial population wherein said gene editing enzyme/system modifies the genome of said target bacteria without introducing a double strand break in the DNA sequence, but does not lead to the death of the target bacteria.

49. The bacteriophage according to embodiment 48 for use for treating a disease or disorder, wherein the gene editing enzyme/system targets a gene within the target bacteria encoding a protein which is directly or indirectly responsible for said disease or disorder.

50. A method to modify the metabolism of a given drug in a host treated with said drug, by modifying at least one drug-targeting enzyme expressed by a bacterial population of the host microbiome, comprising:
contacting the bacterial population with a vector that generates a genetic modification in a DNA sequence coding for a drug-targeting enzyme expressed or secreted by the bacteria in at least some of the bacteria of said population without introducing a double strand break in the DNA sequence,
wherein the genetic modification of the DNA sequence coding for the drug-targeting enzyme results in a modification of the drug metabolism in the host;
wherein genetic modification does not lead to the direct death of the bacteria.

Definitions

«vector»

As used herein, the term "vector" refers to any construct of sequences that are capable of expression of a polypeptide in a given host cell. If a vector is used then the choice of vector is dependent upon the method that will be used to transform host bacteria as is well known to those skilled in the art. Vectors can include, without limitation, plasmid vectors and recombinant phage vectors, or any other vector known in that art suitable for delivering a polypeptide of the invention to target bacteria. The skilled artisan is well aware of the genetic elements that must be present on the vector in order to successfully transform, select and propagate host cells comprising any of the isolated nucleotides or nucleic acid sequences of the invention.

«delivery vehicle»

As used herein, the term «delivery vehicle» refers to any vehicle that allows the transfer of a payload or vector into a bacterium.

There are several types of delivery vehicle encompassed by the present invention including, without limitation, bacteriophage scaffold, virus scaffold, bacterial virus particle, chemical based delivery vehicle (e.g., cyclodextrin, calcium phosphate, cationic polymers, cationic liposomes), protein-based or peptide-based delivery vehicle, lipid-based delivery vehicle, nanoparticle-based delivery vehicles, non-chemical-based delivery vehicles (e.g., transformation, electroporation, sonoporation, optical transfection), particle-based delivery vehicles (e.g., gene gun, magnetofection, impalefection, particle bombardment, cell-penetrating peptides) or donor bacteria (conjugation).

Any combination of delivery vehicles is also encompassed by the present invention.

The delivery vehicle can refer to a bacteriophage derived scaffold and can be obtained from a natural, evolved or engineered capsid.

In some embodiment, the delivery vehicle is the payload or vector as bacteria are naturally competent to take up a payload or vector from the environment on their own.

«payload

As used herein, the term «payload» refers to any nucleic acid sequence or amino acid sequence, or a combination of both (such as, without limitation, peptide nucleic acid or peptide-oligonucleotide conjugate) transferred into a bacterium with a delivery vehicle.

The term «payload» may also refer to a plasmid, a vector or a cargo.

The payload can be a phagemid or phasmid obtained from natural, evolved or engineered bacteriophage genome. The payload can also be composed only in part of phagemid or phasmid obtained from natural, evolved or engineered bacteriophage genome.

In some embodiment, the payload is the delivery vehicle as bacteria are naturally competent to take up a payload from the environment on their own.

«nucleic acid»

As used herein, the term "nucleic acid" refers to a sequence of at least two nucleotides covalently linked together which can be single-stranded or double-stranded or contains portion of both single-stranded and double-stranded sequence. Nucleic acids of the present invention can be naturally occurring, recombinant or synthetic. The nucleic acid can be in the form of a circular sequence or a linear sequence or a combination of both forms. The nucleic acid can be DNA, both genomic or cDNA, or RNA or a combination of both. The nucleic acid may contain any combination of deoxyribonucleotides and ribonucleotides, and any combination of bases, including uracil, adenine, thymine, cytosine, guanine, inosine, xanthine, hypoxanthine, isocytosine, 5-hydroxymethylcytosine and isoguanine. Other examples of modified bases that can be used in the present invention are detailed in Chemical Reviews 2016, 116 (20) 12655-12687. The term "nucleic acid" also encompasses any nucleic acid analogs which may contain other backbones comprising, without limitation, phosphoramide, phosphorothioate, phosphorodithioate, O-methylphosphoroamidite linkage and/or deoxyribonucleotides and ribonucleotides nucleic acids. Any combination of the above features of a nucleic acid is also encompassed by the present invention.

"Phagemid" and "packaged phagemid"

As used herein, the term "phagemid" or "phasmid" are equivalent and refer to a recombinant DNA vector comprising at least one sequence of a bacteriophage genome and which is preferably not able of producing progeny, more particularly a vector that derives from both a plasmid and a bacteriophage genome. A phagemid of the disclosure comprises a phage packaging site and optionally an origin of replication (ori), in particular a bacterial and/or phage origin of replication. In one embodiment, the phagemid does not comprise a origin of replication and thus cannot replicate by itself once injected into a bacterium. Alternatively, the phagemid comprises a plasmid origin of replication, in particular a bacterial and/or phage origin of replication.

As used herein, the term "packaged phagemid" refers to a phagemid which is encapsidated in a bacteriophage scaffold, bacterial virus particle or capsid. Particularly, it refers to a bacteriophage scaffold, bacterial virus particle or capsid devoid of a wild-type bacteriophage genome. The packaged phagemid may be produced with a helper phage strategy, well known from the man skilled in the art. The helper phage comprises all the genes coding for the structural and functional proteins that are indispensable for the phagemid according to the invention to be encapsidated. The packaged phagemid may be produced with a satellite virus strategy, also known from the man skilled in the art. Satellite virus are subviral agent and are composed of nucleic acid that depends on the co-infection of a host cell with a helper virus for all the morphogenetic functions, whereas for all its episomal functions (integration and immunity, multicopy plasmid replication) the satellite is completely autonomous from the helper. In one embodiment, the satellite genes can encode proteins that promote capsid size reduction of the helper phage, as described for the P4 Sid protein that controls the P2 capsid size to fit its smaller genome.

«peptide»

As used herein, the term "peptide" refers both to a short chain of at least 2 amino acids linked between each other and to a part of, a subset of, or a fragment of a protein which part, subset or fragment being not expressed independently from the rest of the protein. In some instances, a peptide is a protein. In some other instances, a peptide is not a protein and peptide only refers to a part, a subset or a fragment of a protein. Preferably, the peptide is from 4, 5, 6, 7, 8, 9, 10, 11, 12, 13, 14, 15 amino acids to 4, 5, 6, 7, 8, 9, 10, 11, 12, 13, 14, 15, 20, 25, 30, 40, 50, 100, 200 amino acids in size.

"homology" and "identity"

By "homology" is meant herein the amino acid sequence of two or more amino acid molecules is partially or completely identical. In certain embodiments the homologous amino acid sequence has 30%, 40%, 50%, 60%, 70%, 80%, 90%, or 95% sequence similarity or identity to the amino acid sequence of reference.

As used herein, the percent homology between two sequences is equivalent to the percent identity between the two sequences. The percent identity is calculated in relation to polymers (e.g., polynucleotide or polypeptide) whose sequences have been aligned. The percent identity between the two sequences is a function of the number of identical positions shared by the sequences (i.e., % homology=# of identical positions/total # of positions x 100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (Comput. Appl. Biosci., 4: 11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. 48:444-453 (1970)) algorithm which has been incorporated into the GAP program in the GCG software package (available at www.gcg.com), using a BLOSUM62 matrix, a BLOSUM30 matrix or a PAM250 matrix, and a gap weight of 16, 14, 12, 10, 8, 6, or 4 and a length weight of 1, 2, 3, 4, 5, or 6. In a specific embodiment the BLOSUM30 matrix is used with gap open penalty of 12 and gap extension penalty of 4.

Brief description of the sequences

| SEQ ID NO: | Description | Type |
|---|---|---|
| 1 | Payload encoding Adenine base editor (ABE8e) and guideRNA targeting mCherry | DNA |
| 2 | Payload encoding Adenine base editor (ABE8e) and guideRNA targeting ß-lactamase | DNA |
| 3 | Payload encoding Cytosine base editor (evoAPOBEC1-nCas9-UGI) and guideRNA targeting mCherry | DNA |
| 4 | Payload encoding Cytosine base editor (evoAPOBEC1-nCas9-UGI) and guideRNA targeting ß-lactamase | DNA |
| 5 | mCherry gene | DNA |
| 6 | β-lactamase gene | DNA |
| 7 | Primase ori deltaGAAABCC | DNA |
| 8 | Primase ori devoid of restriction sites | DNA |
| 9 | insulin B9-25 epitope | Protein |
| 10 | T cell (β2GPI) epitope | Protein |
| 11 | B cell epitope | Protein |
| 12 | primase ori from the PICI of the *Escherichia coli* strain CFT073 | DNA |
| 13 | Restriction site | DNA |
| 14 | PICI primase-helicase | Protein |
| 15 | PICI primase-helicase | DNA |
| 16 | Ro60 B cell epitope | Protein |
| 17 | Ro60 T cell epitope (aa 316-335) | Protein |
| 18 | Ro60 T cell epitope (aa 369-383) | Protein |
| 19-2313 | Candidate mimic peptides | Protein |
| 2314 | RFP gene | DNA |
| 2315 | Payload encoding prime editor (PE) and pegRNA targeting DNARFP | |
| 2316 | ClbP | Protein |
| 2317 | ClbP gene | DNA |
| 2318 | FimH | Protein |
| 2319 | FimH gene | DNA |
| 2320 | Blc | Protein |
| 2321 | Blc gene | DNA |
| 2322 | beta-galactosidase | Protein |
| 2323 | beta-galactosidase gene | DNA |
| 2324 | MYH6$_{614-629}$ | Protein |
| 2325 | Payload encoding prime editor (PE) and pegRNA targeting RFP and containing an inducible promoter | DNA |

EXAMPLES

Example 1—Method to Prevent Colorectal Cancer

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications.

Packaged phagemids are produced following a standard thermal induction protocol[26].

The packaged phagemid contacting the bacteria results in single-amino acid mutations of the ClbP gene in pks+ *E. coli* and the inactivation of the genotoxic activity of the Colibactin toxin, but maintains the antagonistic activity of the toxin. The single-amino acid mutations of the ClbP gene in pks+ *E. coli* are a genetic modification selected from the group consisting of S95A, S95R and K98T[1]. The bacteriophage vector is produced in *E. coli* to high titers and a pharmaceutical composition is prepared. The pharmaceutical composition is administered to human patients to generate in-situ genetic modification of the pks+ *E. coli* of the patient. The administration results in a population of *E. coli* in the patient in which the genotoxic activity of the Colibactin toxin has been inactivated, but the antagonistic activity of the toxin is maintained. Additional administrations over time further result in a diminution of the percentage of *E. coli* in the patient having a Colibactin toxin with genotoxic activity, while increasing the percentage of *E. coli* in the patient having a Colibactin toxin without genotoxic activity. In this way, the exposure of the patient to the negative effects of the genotoxic activity of the Colibactin toxin can be minimized.

Example 2—Method to Stop the Progression of Myocarditis

A method to stop the progression of myocarditis towards lethal cardiomyopathy by in situ genetic modification of the peptidic sequence of *Bacteroides faecis* or *Bacteroides thetaiotaomicron* beta-galactosidase that shows high homology with human MYH6 cardiac peptide is developed[2].

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications.

Packaged phagemids are produced following a standard thermal induction protocol[26].

The packaged phagemid contacting the bacteria results in single-amino acid mutations in the peptidic sequence of *Bacteroides faecis* or *Bacteroides thetaiotaomicron* beta-galactosidase that decreases its homology with human MYH6 cardiac peptide, but maintains the activity of the enzyme. Multiple single-amino acid mutations are analyzed, starting with conservative mutations. The bacteriophage vector is produced in *E. coli.* to high titers and a pharmaceutical composition is prepared. The pharmaceutical composition is administered to human patients to generate in-situ genetic modification of the *Bacteroides* of the patient. The administration results in a population of *Bacteroides* in the patient in which the peptidic sequence of *Bacteroides faecis* or *Bacteroides thetaiotaomicron* beta-galactosidase has decreased homology with human MYH6 cardiac peptide. Additional administrations over time further result in a diminution of the percentage of *Bacteroides* in the patient having a peptidic sequence of *Bacteroides* beta-galactosidase with high homology with human MYH6 cardiac peptide, while increasing the percentage of *Bacteroides* in the patient having a peptidic sequence of *Bacteroides* beta-galactosidase with low homology with human MYH6 cardiac peptide. In this way, the exposure of the patient to the negative auto-immune effects caused by the immune cross-reactivity of the *Bacteroides* protein and the human MYH6 cardiac peptide can be minimized.

Example 3—Screening of Vectors

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications.

Packaged phagemids are produced following a standard thermal induction protocol[26].

The packaged phagemid contacting the bacterial population results in single-amino acid mutations of the ClbP gene in pks+ *E. coli* and the inactivation of the genotoxic activity of the Colibactin toxin. The single-amino acid mutations of the ClbP gene in pks+ *E. coli* will be a genetic modification selected from the group consisting of S95A, S95R and K98T[1].

The phagemid will be contacted with pks+ *E. coli* in vitro. The growth of modified and non-modified *E. coli* will be tested in liquid and solid culture with routine culture techniques to determine the effect of the modifications on growth in vitro.

The phagemid vectors will be then produced in *E. coli*. to high titers and a pharmaceutical composition will be prepared.

The pharmaceutical composition will be administered to a subject mouse to generate in-situ genetic modification of the pks+ *E. coli* of the mouse.

Fecal samples will be collected at daily timepoints and tested by PCR and sequencing to quantitate the levels of modified and un-modified *E. coli*. to determine the percentages of each over time. The comparison of levels of modified and un-modified *E. coli* over time allows for screening for the genetic modifications in the bacteria, for determining the efficiency of vectors at inducing these genetic mutations, and for determining the effects of these mutations on bacterial growth.

Example 4—Editing of Commensals Bacteria Expressing Ro60 Orthologue for Systemic Lupus Erythematosus (SLE) or Subacute Cutaneous Lupus Erythematosus (SCLE) Prevention or Treatment A method to stop the apparition or progression of systemic lupus erythematosus (SLE) or subacute cutaneous lupus erythematosus (SOLE), by in situ genetic modification of the bacterial Ro60 orthologs, more specifically the epitopes of these orthologs.

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications.

Packaged phagemids are produced following a standard thermal induction protocol[26].

The packaged phagemid contacting the bacterial population results in amino acid mutations in the peptidic sequence of the bacterial Ro60 orthologs that decreases its homology with human Ro60 peptide, but maintains the activity of the enzyme. Multiple single-amino acid mutations are analyzed, starting with conservative mutations. The bacteriophage vector is produced to high titers and a pharmaceutical composition is prepared. The pharmaceutical composition is administered to human patients to generate in-situ genetic modification of the patient. The administration results in one or several amino acid mutations in epitope regions of R060 orthologue for one or several commensal bacteria such as *Propionibacterium propionicum*.

The mutation is one or several non-synonymous mutations in:
- the Ro60 B cell epitope (aa 169-190) (TKYKQRNGWSHKDLLRLSHLKP, SEQ ID NO: 16), more specifically the amino acid change will be in the bolded amino acids (TKYKQRNGWSHKDLLRLSHLKP, SEQ ID NO: 16).
- the Ro60 T cell epitope (aa 316-335) (KARIHPFHILIALETYKTGH, SEQ ID NO: 17) more specifically the amino acid change will be in the bolded amino acids (KARIHPFHILIALETYKTGH, SEQ ID NO: 17).
- the Ro60 T cell epitope (aa 369-383) (KRFLAAVDVSASMNQ, SEQ ID NO: 18) more specifically the amino acid change will be in the bolded amino acids (KRFLAAVDVSASMNQ, SEQ ID NO: 18).

A non-limiting list of human commensal bacteria whose genome contains a Ro60 ortholog is: *Actinomyces massiliensis* F0489 (HMPREF1318_2237), *Actinomyces* sp. Oral taxon 414 (AM609_00765), *Corynebacterium amycolatum* SK46 (CORAM0001_1910), *Mycobacterium smegmatis* (strain ATCC 700084/mc(2)155) (MSMEG_1193), *Parascardovia* denticolenslPLA 20019 (A200_07914), *Propionibacterium* prop F0230a (HMPREF9154_0590), *Segniliparus rugosus* ATCC BAA-974 (HMPREF9336_02315), *Streptomyces* sp. HGB0020 (HMPREF1211_06263), *Bacteroides theta* 7330 (Btheta7330_01248), *Chryseobacterium gleum* ATCC 35910 (HMPREF0204_10833), *Prevotella* sp. CAG:1092 (BN465_02442), *Clostridium* sp. BL8 (M918_10850), *Paenibacillus* sp. HGF7 (HMPREF9413_2200), *Paenibacillus* sp. HGH0039 (HMPREF1207_01859), *Eikenella corrodens* ATCC 23834 (EIKCOROL_00065), *Kingella oralis* ATCC 51147 (GCWU000324_03050), *Neisseria elongata* subsp. glycolytica ATCC 29315 (NEIELOOT_02899), *Neisseria flavescens* strain CD-NF1 (TV01_0020), *Neisseria macacae* ATCC 33926 (HMPREF9418_1500), *Neisseria mucosa* strain C6A (E517_04055), *Neisseria shayeganii* 871 (HMPREF9371_0707), *Neisseria sicca* ATCC 29256 (NEISICOT_02760), *Neisseria* sp. GT4A_CT1 (HMPREF1028_01178), *Neisseria* sp. oral taxon 020 str. F0370 (HMPREF9120_02756), *Neisseria subflava* NJ9703 (NEISUBOT_04391), *Cardiobacterium valvarum* F0432 (HMPREF9080_02018), *Synergistes* sp. 3_1_syn1 (HMPREF1006_01942).

More preferably the human commensal bacteria targeted by bacteriophage vector are: *Propionibacterium propionicum, Corynebacterium amycolatum, Actinomyces massiliensis, Bacteroides thetaiotaomicron.*

Example 5—Editing of Pathogenic *Escherichia coli* In Situ

*E. coli* is a commensal enterobacteria but specific strains have been associated with numerous pathology inside and outside the gut among which inflammatory bowel disease (IBD), urinary tract infection (UTI), Hemolytic uremic syndrome (HUS), Gastroenteritis or colorectal cancer. The pathogenicity of these specific strains originates from virulence genes some of which are acquired by horizontal gene transfer such as shiga toxin genes (stx) carried by temperate phages or by mutations in specific genes.

A method to reduce or abolish the pathogenic properties of the gut bacteria *Escherichia coli* by in situ genetic modification of peptidic sequence of virulence gene notably genes involved in the inflammatory properties of *E. coli* is described below.

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications. Packaged phagemids are produced following a standard thermal induction protocol[26].

The phagemid contact the bacterial population resulting in the mutation of one or several non-synonymous mutations in:
- the FimH gene that results in reverting the following mutations: N70S and S78N associated with AEIC strains[1].
- the ChiA gene that results in reverting the following mutations: K362Q, K370E, A378V, E388V, V548E[24]
- the OmpA gene that results in reverting the following mutation: A200V[25]
- the OmpC gene that results in reverting the following mutation: V220I, D232A[25]
- the OmpF gene that results in reverting the following mutation: E51V, M60K[25]
- the blc gene in *E. coli* that results in reverting the following mutation G84E (G251A at the nucleotide level) potentially associated to gut inflammation[4]

Example 6—Editing of *Staphylococcus epidermidis* In Situ

*Staphylococcus epidermidis* is with *Cutibacterium acnes* one of the two most prevalent and abundant commensal bacteria on the human skin. As such it has been shown to prevent colonization by pathogenic bacteria like its close relative *Staphylococcus aureus*, prevent skin cancer or also modulate the human immune system. However, it is also a growing concern due to its opportunistic pathogenic characteristic and its growing resistance to antibiotics. These pathogenic traits of *S. epidermis* might be encoded on specific virulence genes or cluster and some of these might spread across strains by horizontal gene transfer.

A method to reduce or abolish the pathogenic properties of *S. epidermidis* by in situ genetic modifications of peptidic sequences of virulence genes is described below.

A phagemid is generated containing a phage packaging site, a base editor enzyme containing a dCas9 or nCas9 fused to a deaminase domain for inducing genetic modifications or a primer editor enzyme containing a dCas9 or nCas9 fused to a reverse transcriptase domain for inducing genetic modifications.

Packaged phagemids are produced following a standard thermal induction protocol[26].

The packaged phagemid contacting the bacterial population results in one or several genetic mutations that lead to reduction or elimination of the pathogenicity. This can be done by for example: non-synonymous mutations, mutations leading to gene disruption such as introduction of stop codons or mutations in regulatory sequences such as promoter, transcription binding sites.

The genetic mutations is targeted towards one or several genes associated with *S. epidermidis* infection as described in Méric et al[27] and listed here: id1001_1081, SE_p608, SE0037, SE0038, SE_p609, id1001_1086, SE0058, SE_p205, SE_p603, SEA0027, SE0036, SE0033, SE0053, SE0055, SE_p522, SE_p610, SE_p611, id1001_1083, id1067_0124, id268_0008, SE0090, SE2153, id1001_0181, id1067_0123, id1074_1993, SE0023, SE0030, SE0103, SE0120, SE0129, SE_p607, SEA0003, id1001_2175, id1001_2181, SE0031, SE0069, SE0076, SE0107, SE0115, SE_p602, SE_p606, SEA0022, SEA0030, id2_1533, id1001_0179, id1001_0180, id1001_0186, id1001_0194, id1001_0203, id1001_2173, id1001_2184, id1001_2209, id1067_0125, id1067_0126, id1074_0268, id1075_0004, id1092_0129, SE0004, SE0020, SE0114, SE0127, SE0282, SE1013, SE1106, SE1292, SE2395, SE_p605, SEA0004, SEA0008, id1001_0187, id1001_2183, id1001_2208, id1021_0918, id1074_0267, SE0005, SE0021, SE0050, SE0063, SE0118, SE1588, SE1632, SE1920, SE_p507, SEA0002, SEA0020, SEA0021, id1001_0910, id1001_2159, id1001_2206, id1021_0613, id1032_2361, id1032_2362, id1067_0112, id1067_0226, id1067_0227, id1067_1124, id429_2314, SE0045, SE0051, SE0054, SE0101, SE0109, SE0112, SE0116, SE0119, SE0145, SE0175, SE0803, SE0852, SE1092, SE1102, SE1103, SE1107, SE1118, SE1128, SE1429, SE1455, SE1587, SE1607, SE1983, SE2011, SE2079, SE2208, SE2251, SE2260, SE2409, SE_p103, SE_p508, SE_p521, SEA0005, id1001_0007, id1001_0010, id1001_0183, id1001_0191, id1001_0199, id1001_0912, id1001_1283, id1001_2163, id1001_2164, id1001_2169, id1001_2174, id1001_2185, id1031_0178, id1067_0113, id1074_2138, id429_2315, id429_2316, id429_2317, id429_2319, SE0001, SE0009, SE0016, SE0032, SE0071, SE0102, SE0104, SE0106, SE0108, SE0111, SE0122, SE0146, SE0148, SE0182, SE0197, SE0230, SE0231, SE0240, SE0263, SE0273, SE0306, SE0629, SE0800, SE0804, SE0805, SE0815, SE0817, SE0825, SE0828, SE1037, SE1094, SE1096, SE1105, SE1458, SE1605, SE1606, SE1613, SE1728, SE1917, SE1919, SE1921, SE2160, SE2192, SE2220, SE2257, SE_p410, id1001_0011, id1001_0182, id1001_0190, id1001_1084, id1001_1085, id1001_1264, id1001_1972, id1001_1984, id1001_1986, id1001_2203, id1005_0195, id1005_1733, id1005_1734, id1021_0933, id1021_1637, id1021_1670, id1021_1674, id1031_0580, id1031_0911, id1031_0919, id1031_0920, id1031_0922, id1031_1192, id1067-0106, id1067-0107, id1067-0111, id1067_1095, id1067_1493, id1091_1647, id505_1243, SE0002, SE0003, SE0008, SE0010, SE0019, SE0034, SE0064, SE0105, SE0110, SE0128, SE0137, SE0140, SE0157, SE0162, SE0181, SE0183, SE0186, SE0191, SE0241, SE0248, SE0253, SE0254, SE0266, SE0268, SE0307, SE0331, SE0470, SE0692, SE0693, SE0694, SE0802, SE0806, SE0841, SE0917, SE1059, SE1083, SE1090, SE1104, SE1211, SE1459, SE1598, SE1628, SE1637, SE1649, SE1770, SE1772, SE1777, SE1872, SE1897, SE1900, SE1918, SE1925, SE1926, SE1927, SE1931, SE1985, SE2021, SE2042, SE2044, SE2045, SE2091, SE2124, SE2152, SE2193, SE2201, SE2221, SE2222, SE2244, SE2246, SE2250, SE2401, SE2403, SE2408, SE_p203, SE_p206, SE_p405, SE_p406, SE_p506, SEA0001, SEA0029, id2_1530, id1001_0188, id1001_0911, id1001_1285, id1001_1982, id1005_1719, id1021_0758, id1021_0930, id1021_1658, id1021_1663, id1021_2114, id1031_1153, id1031_1190, id1031_1202, id1031_1222, id1031_1428, id1067-1094, id1067-1098, id1067-1099, id1067-1106, id1067-1135, id1091_2272, id1120_2061, id262_0707, id262_0708, id304_0202, id53_0678, SE0013, SE0015, SE0022, SE0121, SE0126, SE0135, SE0142, SE0149, SE0152, SE0185, SE0194, SE0196, SE0212, SE0226, SE0232, SE0237, SE0242, SE0243, SE0259, SE0262, SE0269, SE0272, SE0274, SE0275, SE0276, SE0278, SE0279, SE0281, SE0299, SE0305, SE0355, SE0435, SE0456, SE0604, SE0673, SE0689, SE0701, SE0704, SE0705, SE0707, SE0716, SE0779, SE0782, SE0808, SE0814, SE0818, SE0836, SE0839, SE0990, SE1082, SE1097, SE1108, SE1109, SE1122, SE1136, SE1138, SE1196, SE1207, SE1288, SE1456, SE1464, SE1546, SE1574, SE1580, SE1585, SE1589, SE1603, SE1604, SE1643, SE1735, SE1773, SE1827, SE1836, SE1899, SE1914, SE1915, SE1938, SE1946, SE2005, SE2022, SE2036, SE2041, SE2043, SE2052, SE2071, SE2074, SE2090, SE2116, SE2148, SE2149, SE2154, SE2167, SE2175, SE2194, SE2198, SE2199, SE2210, SE2215, SE2223, SE2225, SE2229, SE2259, SE2306, SE2314, SE2333, SE2337, SE2342, SE2379, SE2388, SE2394, SE_p411, SEA0006, id1001_0185, id1001_2167, id1001_2190, id1005_0702, id1005_0703, id1005_0704, id1005_1752, id1021_0787, id1021_1631, id1021_1651, id1021_1652, id1021_1667, id1021_1669, id1021_1671, id1021_1673, id1031_1154, id1031_1160, id1031_1169, id1031_1173, id1031_1179, id1031_1182, id1031_1431, id1031_2369, id1032_2377, id1036_1869, id1036_1871, id1067_1096, id1067_1097, id1067_1104, id1067_1117, id1067_1130, id1068_0108, id1068_0584, id1074_1751, id1074_2133, id1091_2269, id1092_1189, id267_0755, id324_1262, SE0014, SE0066, SE0117, SE0123, SE0134, SE0144, SE0163, SE0180, SE0195, SE0223, SE0229, SE0250, SE0251, SE0255, SE0261, SE0280, SE0301, SE0410, SE0444, SE0450, SE0455, SE0615, SE0637, SE0657, SE0663, SE0664, SE0669, SE0670, SE0683, SE0684, SE0690, SE0700, SE0706, SE0713, SE0785, SE0790, SE0797, SE0813, SE0816, SE0832, SE0909, SE1075, SE1080, SE1085, SE1089, SE1121, SE1132, SE1133, SE1175, SE1183, SE1184, SE1210, SE1212, SE1311, SE1348, SE1397, SE1408, SE1442, SE1460, SE1470, SE1516, SE1577, SE1581, SE1629, SE1635, SE1726, SE1727, SE1779, SE1785, SE1932, SE1949, SE1953, SE1954, SE1957, SE1959, SE1978, SE2012, SE2019, SE2023, SE2037, SE2046, SE2053, SE2054, SE2075, SE2085, SE2087, SE2088, SE2093, SE2094, SE2095, SE2114, SE2186, SE2191, SE2197, SE2213, SE2228, SE2230, SE2232, SE2242, SE2245, SE2247, SE2252, SE2253, SE2255, SE2256, SE2258, SE2298, SE2380, SE2384, SE2393, SE2396, SE2397, SE2406, SE2407, SE2411, SE2412, SE2415, SE_p409, SEA0033, id2_0245, id1001_0986, id1001_2165, id1021_0310, id1021_1615, id1021_1628, id1021_1635, id1021_1638, id1021_1654, id1021_1655, id1021_1659, id1021_1668, id1031_1165, id1031_1170, id1031_1171, id1031_1172, id1031_1174, id1031_1178, id1031_1181, id1031_1183, id1031_1224, id1031_1432, id1032_2373, id1067_1146, id1068_0610, id1074_0173, id1121_0371, id267_0744, id267_0753, id268_1096, id277_0533, id277_0629, id284_0382, id312_1160.

Preferably the genetic mutations is targeted towards one or several genes associated with S. epidermidis infection in the following list: SE0023, SE0101, SE0121, SE0128, SE0275, SE0281, SE0307, SE1105, SE1128, SE1459, SE2197, SE2245, SE2259, SE_p521, id1001_2159, id1068_0108, id1091_1647, SE0197, SE0704, SE0705, SE0706, SE0707, SE1632, SE2201, id1001_0010, SE0004, SE0030, SE0031, SE0033, SE0036, SE0050, SE0053, SE0055, SE0076, SE0090, SE0111, SE1897, id1067_0123, id1067_0124, id1067_0125, id1067_0126, id1067_0226, id1067_0227, SE0102, SE0103, SE0104, SE0105, SE0106, SE0107, SE0108, SE0110, SE0117, SE0157, SE0175, SE0673, SE0818, SE0828, SE1311, SE1637, id1067_1493, id324_1262.

Example 7—Base Editing of mCherry on the E. coli Genome after Transformation In Vitro This example presents a method for the base editing of the nucleic acid sequence encoding fluorescent protein mCherry (SEQ ID NO: 5) on the E. coli MG1655 genome after transformation with a DNA payload encoding a base editor. Fluorescence was measured by flow cytometry of individual colonies after transformation and overnight selection on chloramphenicol plates.

Figure 4A:
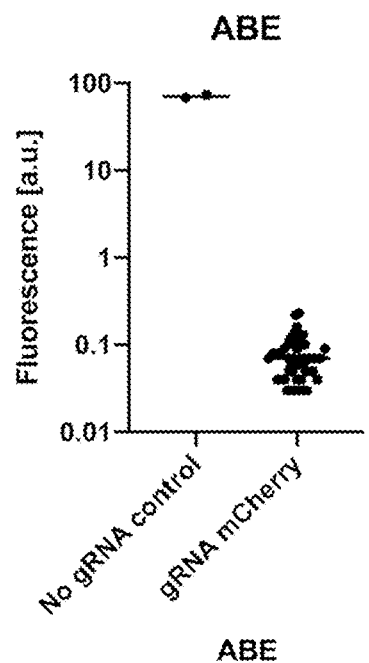
FIGS. 4A-B presents graphs showing base editing of mCherry on the E. coli genome after transformation in vitro.
Figure 7:
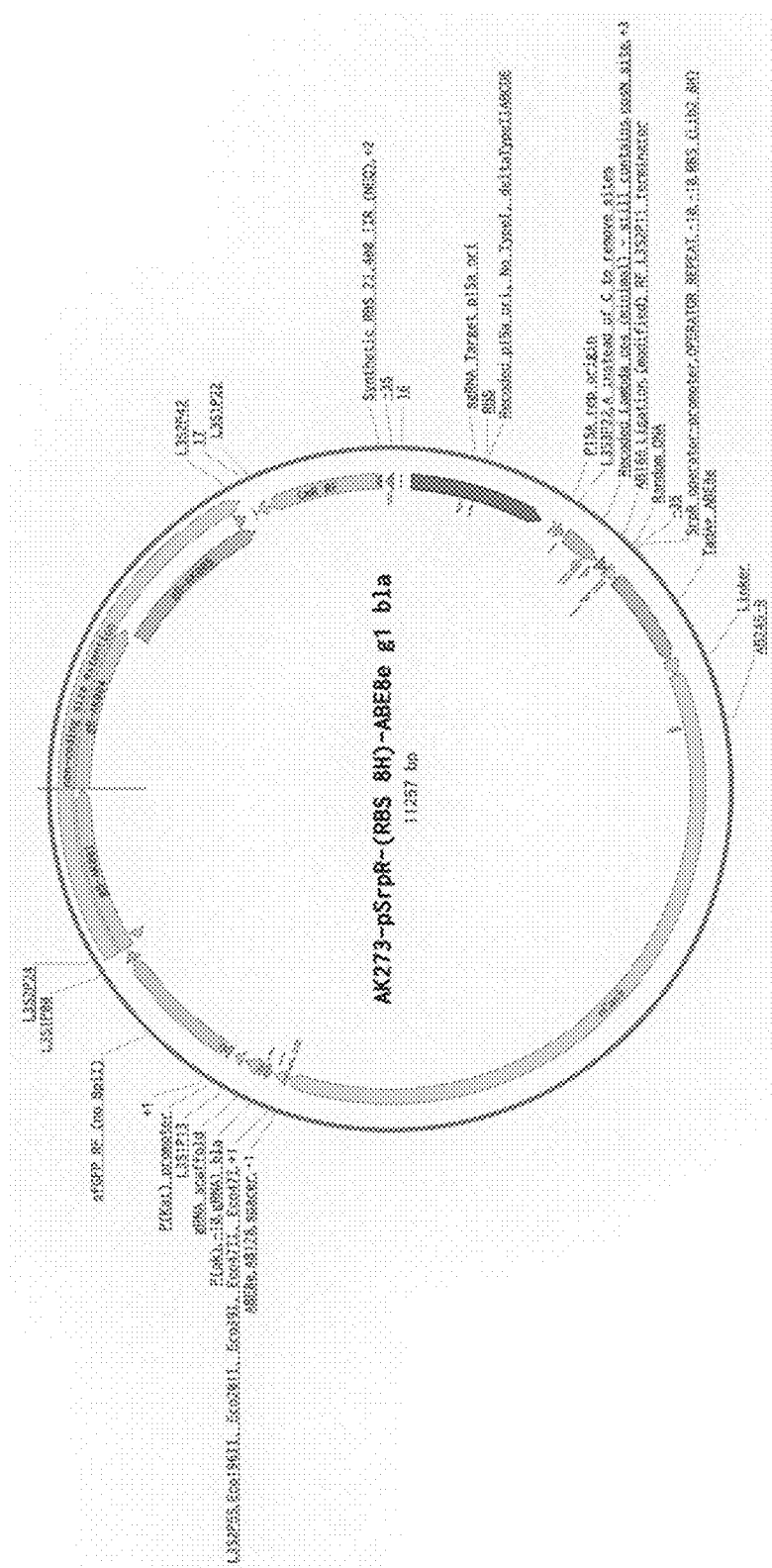
FIGS. 7 and 8 depict the plasmid maps of the constructed base editors. Adenine base editing was exemplarily performed by ABE8e (FIG. 7; SEQ ID NO: 2). ABE8e comprises an evolved TadA* gene fused to a nCas9 (D10A). Cytosine base editing was exemplarily performed by evoAPOBEC1-nCas9-UGI (FIG. 8; SEQ ID NO: 4). The UGI fused to the nCas9 (D10A) prevents the repair of U:G mismatches back into C:G base pairs. The DNA payloads carry a cos site for packaging into lambda phagemid particles.

As shown on FIG. 4A, the adenine base editor ABE8e (SEQ ID NO: 1, plasmid map shown on FIG. 7) deactivated the active site of mCherry (tripeptide: M71, Y72, G73) while enabling the translation of the full-length protein.

Figure 4B:
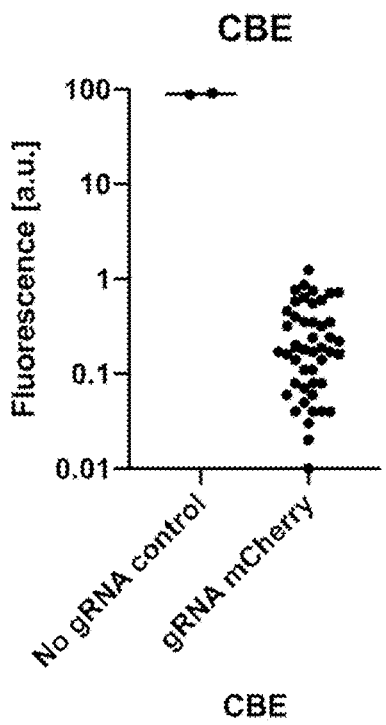
Figure 8:
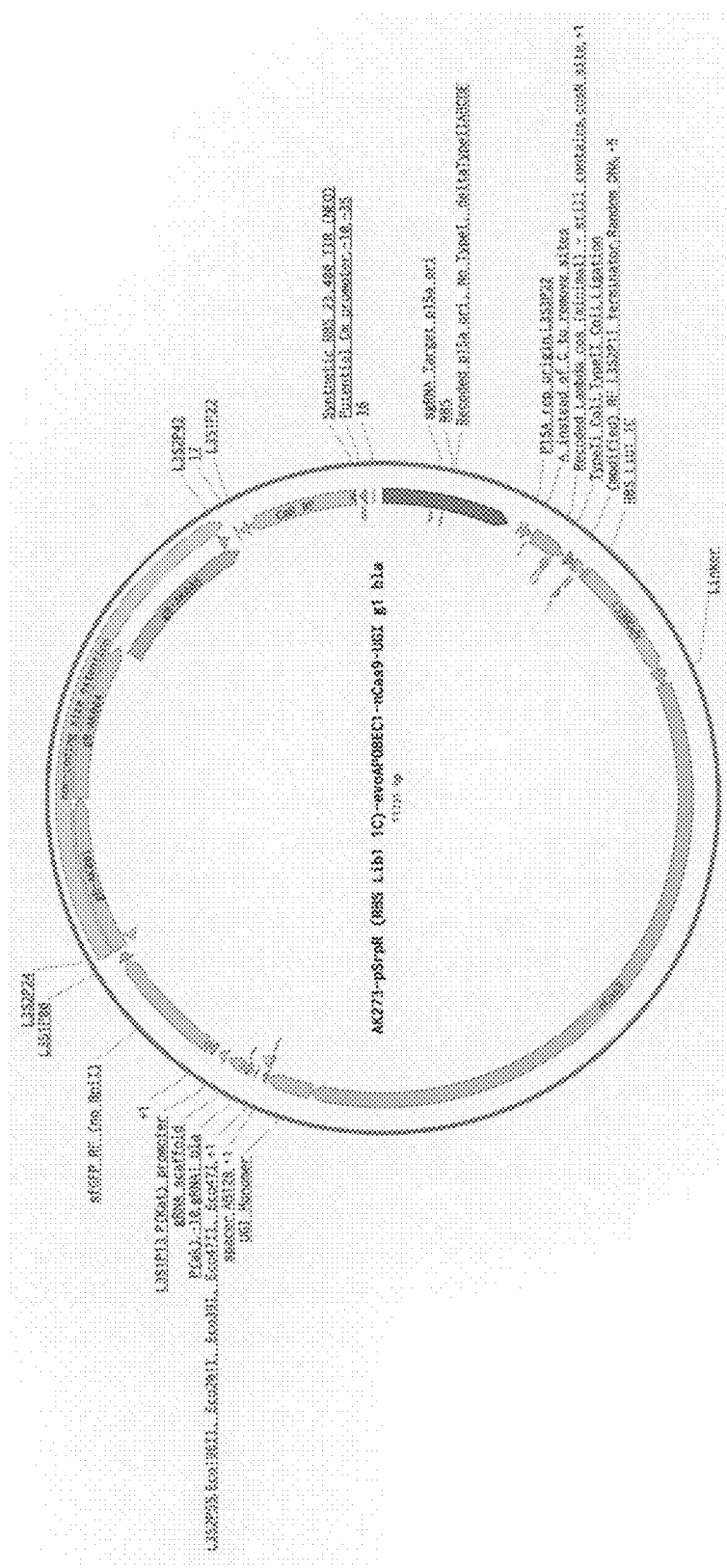

As shown on FIG. 4B, the cytosine base editor (evoAPOBEC1-nCas9-UGI; SEQ ID NO: 3, plasmid map shown on FIG. 8) inserted a stop codon (Q114) into the target gene mCherry resulting in the loss of fluorescence.

As a control, base editors were transformed in the absence of a guideRNA (2 colonies analysed) leading to fluorescent mCherry expression.

All of the 48 analysed colonies targeting mCherry via the same guideRNA were successfully edited, leading to a loss of fluorescence. The mCherry gene of five colonies was sequenced, which confirmed successful base editing.

Figure 5A:
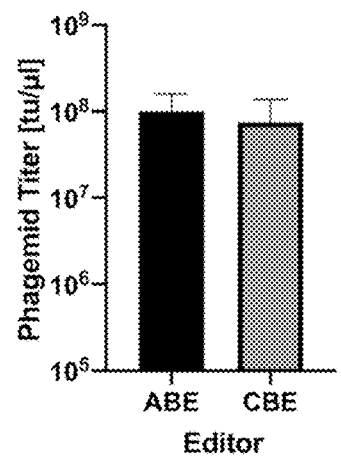
FIGS. 5A-C presents histograms and graphs showing base editing of β-lactamase on the E. coli genome after phagemid transduction in vitro.

Example 8—Base Editing of β-Lactamase on the E. coli Genome after Packaged Phagemid Transduction In Vitro This example presents a method for the base editing of the nucleic acid sequence encoding β-lactamase (SEQ ID NO: 6) on the E. coli MG1655 genome after packaged phagemid transduction in vitro. As shown on FIG. 5A, production of packaged lambda phagemids (within a bacterial delivery vehicle comprising an A8 gpJ protein and a P2 STF protein enabling transduction into MG1655 strain) encoding a base editor (ABE or CBE) and a transcribed guideRNA targeting the active site of the β-lactamase gene (K71E) on the genome, and further carrying a lambda packaging sequence, a chloramphenicol resistance marker, and a p15A origin of replication, resulted in titers of ~$10^8$ transduction units (tu) per μl.

Cells were plated on carbenicillin plates 2 hours post transduction in order to analyse base editing efficiency.

Figure 5B:
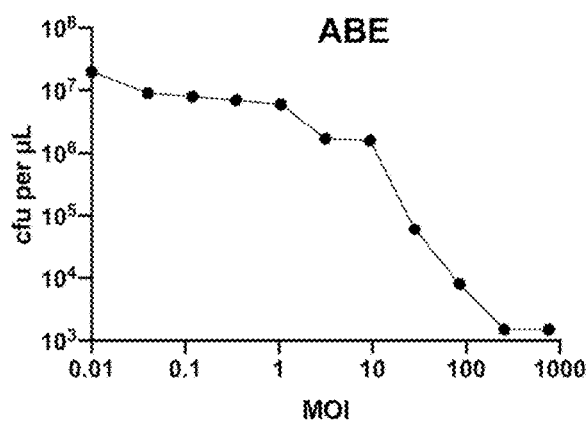
Figure 5C:
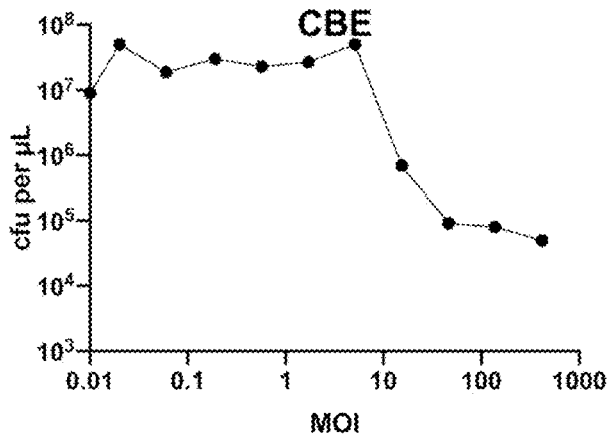

As shown on FIG. 5B, the efficiency of adenine base editing (using ABE8e; SEQ ID NO: 2) targeting the active site of the β-lactamase gene (K71E) on the genome was multiplicity of infection (MOI)-dependent. The efficiency of cytosine base editing (using evoAPOBEC1-nCas9-UGI; SEQ ID NO: 4) inserting a stop codon into the β-lactamase gene on the bacterial genome was also MOI-dependent (FIG. 5C). ABE or CBE resulted in ~4 log or ~3 log reduction of cell growth at high MOIs, respectively.

Example 9—Adenine Base Editing of β-Lactamase after Transduction into E. coli in oligoMM Mice In Vivo This example presents a method for the adenine base editing (using ABE8e, SEQ ID NO: 2) of a target gene (β-lactamase; SEQ ID NO: 6) after phagemid transduction into E. coli in an oligo-mouse-microbiota model in vivo.

The packaged phagemid titer (within a bacterial delivery vehicle comprising an A8 gpJ protein and a P2 STF protein enabling transduction into MG1655 strain) for the in vivo experiment was $1.5 \times 10^9$ transduction units per μl (tu/μl). Said phagemid carries the expressed adenine base editor ABE8e under the SrpR promoter and a constitutively transcribed guideRNA targeting the active site of the β-lactamase gene (K71E) on the genome. Furthermore, said phagemid carries a lambda packaging sequence, a chloramphenicol resistance marker, and a p15A origin of replication.

An E coli strain carrying the β-lactamase gene was administered to 10 individual mice aged 7 weeks at $10^7$ CFU per mouse. Two packaged phagemid doses (100 μl packaged phagemid+100 µl sucrose bicarbonate per mouse) were orally administered to the mice at 0 h and 30 h. Stool samples were analysed 0, 6, and 48 hours post initial phagemid transduction (48, 96, 88 colonies, respectively).

Cells were plated on streptomycin, chloramphenicol, and carbenicillin plates in order to analyse delivery and editing efficiency. Editing of the active site of β-lactamase (K71E) resulted in a loss of cell growth on carbenicillin plates.

Figure 6:
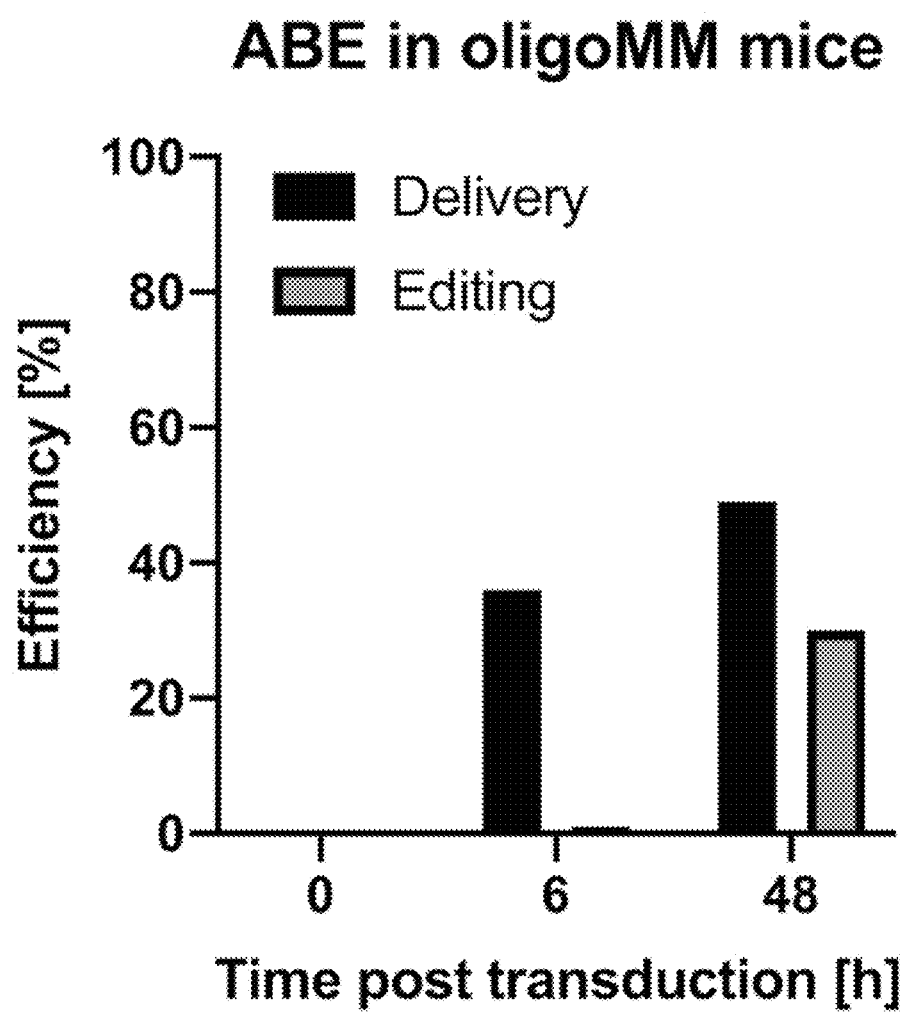
FIG. 6 presents histograms showing adenine base editing of β-lactamase after transduction into E. coli in oligoMM mice in vivo. The packaged phagemids titer for the in vivo experiment was $1.5 \times 10^9$ transduction units (tu)/µl. Stool samples were analysed 0, 6, and 48 hours post transduction (48, 96, 88 colonies, respectively). Cells were plated on streptomycin, chloramphenicol, and carbenicillin plates in order to analyse delivery and editing efficiency. Editing of the active site of β-lactamase (K71) results in a loss of cell growth on carbenicillin plates.

As shown on FIG. 6, after 48 hours, ~49% of the targeted bacteria population carried the DNA payload and ~30% of the whole population were base edited in vivo. The percentage of payload delivery could be further increased by higher phagemid titers and/or cumulative doses.

Figure 9:
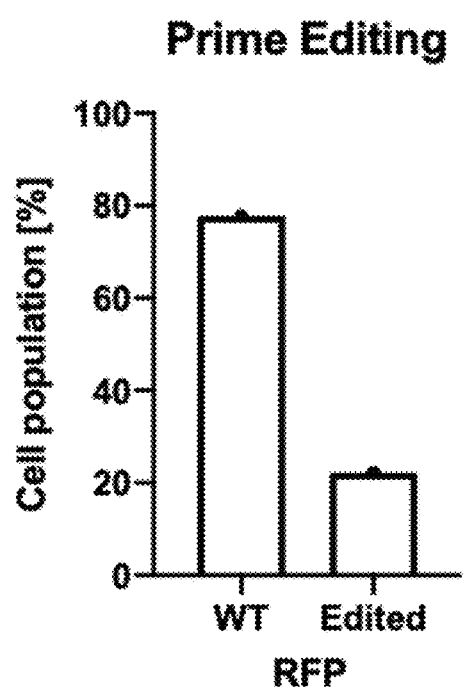
FIG. 9 displays histograms showing prime editing of Red Fluorescent Protein (RFP) on the E. coli genome in vitro. The genomic RFP gene was amplified from 18 individual colonies and the resulting PCR fragments were sequenced. The editing efficiency was calculated from these data.

Example 10—Prime Editing of Red Fluorescent Protein (RFP) on the *E. coli* Genome In Vitro This example presents a method for the prime editing of the nucleic acid sequence encoding the Red Fluorescent Protein RFP (SEQ ID NO: 2314) on the *E. coli* genome after transformation with a DNA payload (FIG. 9). The payload encodes a prime editor (PE; payload of sequence SEQ ID NO: 2315), a transcribed prime editing guide RNA (pegRNA), a lambda packaging sequence, a chloramphenicol resistance marker, and a p15A origin of replication. The pegRNA consists of an extended single guide RNA containing a primer binding site and a reverse transcriptase sequence in order to replace RFP's amino acid E16 (GAA) with a stop codon (TAA) on the bacterial genome.

The prime editor (PE; payload of sequence SEQ ID NO: 2315) was engineered to insert a stop codon at position E16 of the target gene RFP resulting in a loss of red fluorescence.

As a control, the prime editor was transformed in the absence of a pegRNA leading to fluorescent RFP production.

The genomic RFP gene was amplified from 18 individual colonies after transformation and overnight selection on chloramphenicol plates. The resulting PCR fragments were sequenced and the editing efficiency calculated.

As shown in FIG. 9, the stop codon was present in four of these individual colonies (~22% of the bacterial population) confirming successful prime editing.

Example 11: Description of the System Used for Non-Replicative Payloads

Figure 11:
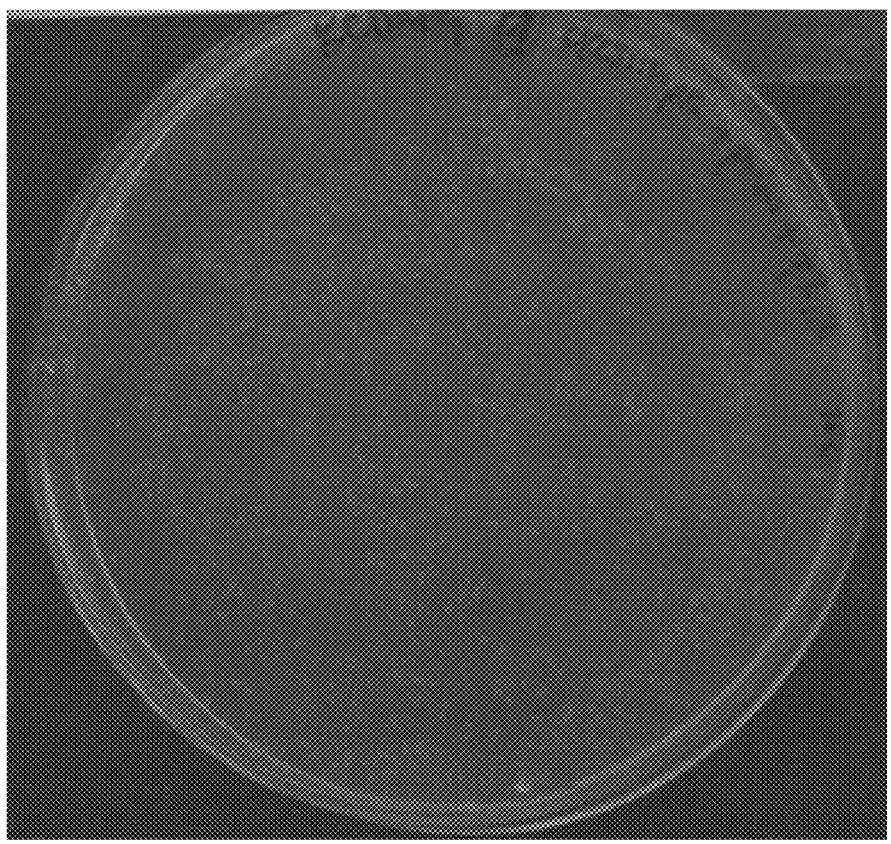
FIG. 11 displays a picture showing transformation of a 2.3 kb payload containing the primase-origin of replication in a production strain harboring an inducible primase RBS library in trans.

The inventors developed a system in which the payload contains the 282-bp primase origin and the primase protein is supplied in trans (SEQ ID NO: 8 and SEQ ID NO: 14). To simplify the engineering process, the PICI primase gene was extracted from the genome of *E. coli* CFT073, cloned into a plasmid under the control of an inducible system and an RBS (ribosome-binding site) library generated. This series of plasmids were cloned in the lambda production strain s1965. Next, the inventors constructed a small payload harboring the primase-ori instead of the p15a-based origin of replication to yield a 2.3 kb payload. Since this plasmid is, in principle, non-replicative, competent cells of s1965 harboring the RBS library of inducible primase constructs were made, the plasmid transformed in them and plated in LB agar+kanamycin and chloramphenicol in the presence of the inducer DAPG (to induce the expression of the primase in trans). Next day, the inventors observed that the plates contained hundreds of colonies, suggesting that the primase-origin system in trans works (FIG. 11).

Several clones were sequenced to verify that the plasmid contained no p15a-based origin and that they also contained an intact primase gene with an RBS coming from the library.

After that, 7 of these clones were grown overnight and lambda productions were carried out in the presence of kanamycin, chloramphenicol and DAPG. As a control, the inventors included the original 2.8 kb plasmid containing a derivative of the p15a origin of replication to compare titers.

To verify the sequence of the RBS variants obtained, the plasmid encoding the inducible primase in the 7 clones tested was miniprepped and sequenced. They were also transformed into MG1655 cells (s003): these strains were used to verify the titers obtained, since the payloads should not be replicative in the absence of the primase protein supplied in trans.

Figure 12:
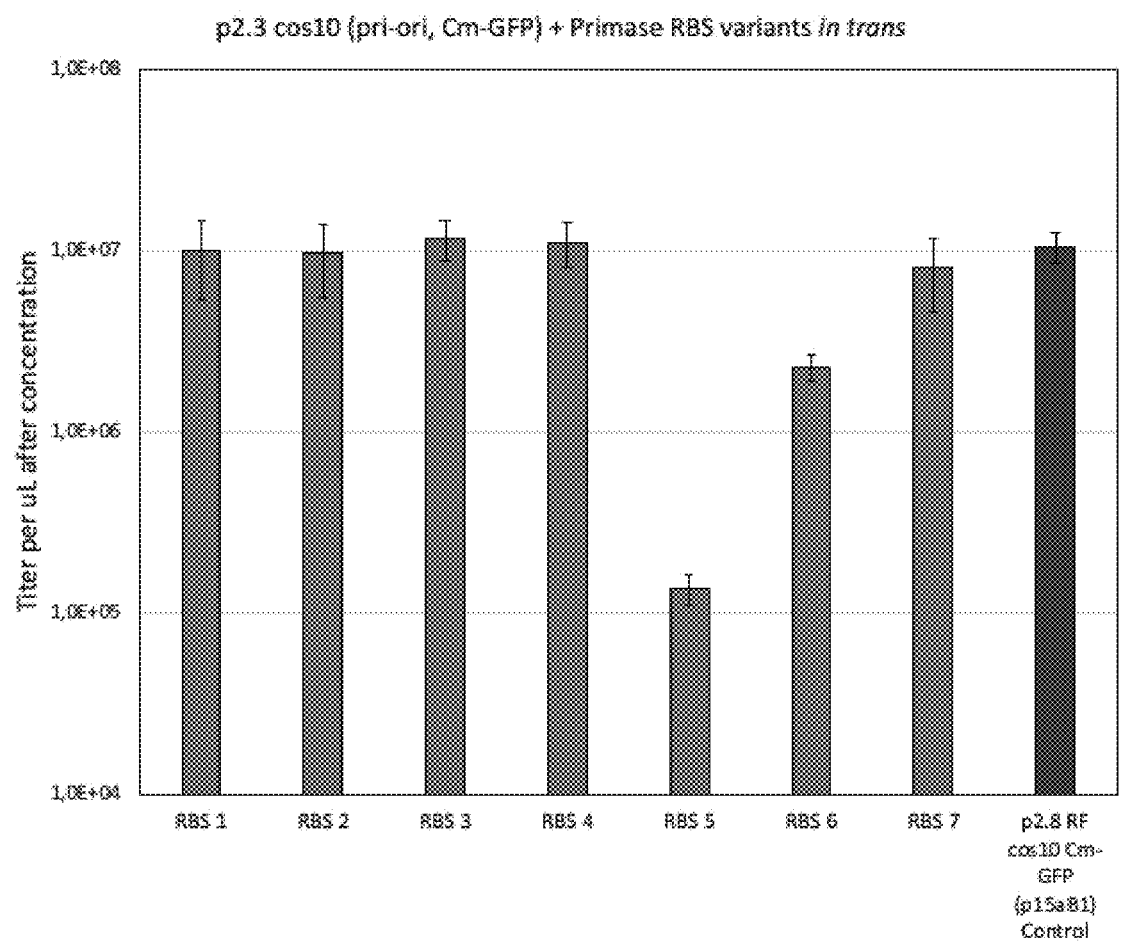
FIG. 12 displays histograms comparing packaged phagemids titers obtained with a plasmid containing the primase-ori in production strains tested against 7 different primase RBS. Right column, in black, control plasmid with a p15a-derived origin of replication. Titers shown are after a 10× concentration.

As can be seen on FIG. 12, the titers of 5 out of 7 primase-containing samples, as measured in MG1655 containing the primase plasmid in trans, were the same as those of a packaged phagemid carrying the original modified p15a origin.

Figure 13:
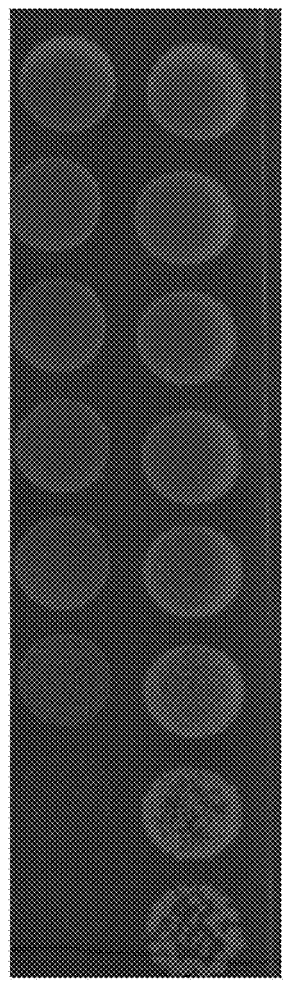
FIG. 13 displays a picture comparing cells transduced with a primase-ori plasmid (top row) and a p15a-based packaged phagemids on LB agar plus 25 µg/mL chloramphenicol.

Finally, the inventors tested if the primase-ori containing payloads could replicate in MG1655 strains without the primase plasmid in trans. To do this, serial 5X dilutions of the primase-ori containing plasmids coming from the production strains with different primase RBS, plus a p15a-origin control, were transduced into a dense culture (OD600 ~0.8) of MG1655 and plated on LB agar plates containing chloramphenicol. As can be seen on FIG. 13, while the p15a-origin control shows healthy colonies up to the last dilution, indicative of active plasmid replication, the samples containing the primase-containing payload show colonies only at high MOIs: since the strain will lose the payload by division, those drops that contained a high number of transduced bacteria will appear as dense spots since division will be halted at high cell densities; as the MOIs are reduced, the spots become more transparent and single colonies are hard to distinguish, indicative of cells that are dying due to plasmid loss and exposure to antibiotics. This is also indicative of a burst of expression of the chloramphenicol acetyltransferase gene upon transduction, which, in the absence of active replication, will get diluted over time; this may cause the receiver cells to survive for a certain amount of time until the intracellular concentration of chloramphenicol acetyltransferase drops below a critical level to support growth in antibiotic-supplemented media.

Figure 10:
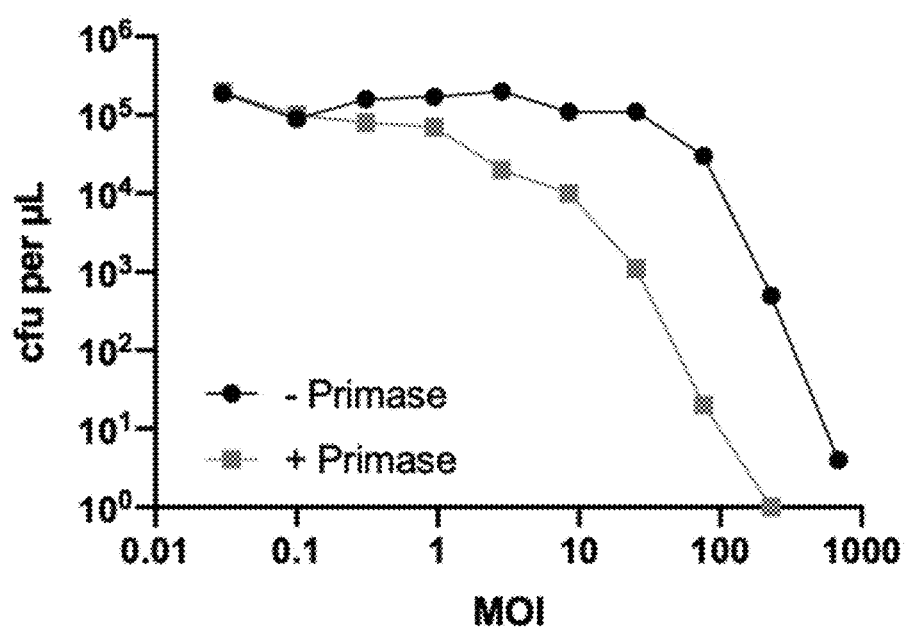
FIG. 10 displays a graph showing adenine base editing of β-lactamase on the E. coli genome after packaged phagemid transduction in vitro using a non-replicative payload based on a primase-helicase. An MG1655 strain encoding the β-lactamase gene was transduced in the presence or absence of the primase-helicase protein expressed inside the cell. Transduced cells were plated on LB and LB (carbenicillin) plates 2 hours post transduction at different multiplicity of infections (MOI). The next day, base editing efficiency was analyzed via colony counting.

Example 12—Adenine Base Editing of β-Lactamase on the *E. coli* Genome after Packaged Phagemid Transduction In Vitro Using a Non-Replicative Payload This example presents a method for the base editing of the nucleic acid sequence encoding β-lactamase (SEQ ID NO: 6) on the *E. coli* MG1655 genome after packaged phagemid transduction in vitro using a non-replicative payload based on a primase-helicase as disclosed in Example 11 (FIG. 10). The non-replicative payload consists of an adenine base editor (ABE8e), a transcribed guideRNA targeting the active site of the β-lactamase gene (K71E) on the genome, a lambda packaging sequence, a chloramphenicol resistance marker, and the conditional origin of replication (dependent on the presence of a primase-helicase) of sequence SEQ ID NO: 8. Production of lambda phagemids, packaged inside a bacterial delivery vehicle comprising an A8 gpJ protein and a p2 STF protein for delivery into *E. coli* MG1655, resulted in titers of $7.4 \times 10^7$ transduction units per µl (tu/µl).

Transduced cells were plated on LB and LB (carbenicillin) 2 hours post transduction at different multiplicity of infections (MOI). The next day, base editing efficiency was analyzed via colony counting.

As can be seen on FIG. 10, the efficiency of adenine base editing targeting the active site of the β-lactamase gene (K71E) on the genome was multiplicity of infection (MOI)-dependent. A base editing efficiency of >4 logs was obtained at high MOIs using the non-replicative payload, confirming the efficiency of base editing even using a conditional origin of replication which prevents replication of the payload inside the targeted *E. coli* MG1655 bacteria.

Example 13—Base Editing of β-Lactamase on the *E. coli* Genome after Phagemid Transduction in oligoMM Mice In Vivo Using a Non-Replicative Payload Based on a Primase-Helicase This example presents a method for the adenine base editing (ABE8e-primase, SEQ ID NO: 2) of a target gene (e.g. β-lactamase; SEQ ID NO: 6) after packaged phagemid transduction in vivo into *E. coli* in an mouse colonization model. The packaged phagemids titer for the in vivo experiment was $1.5 \times 10^{10}$ transduction units per µl (tu/µl) after purification.

Figure 14:
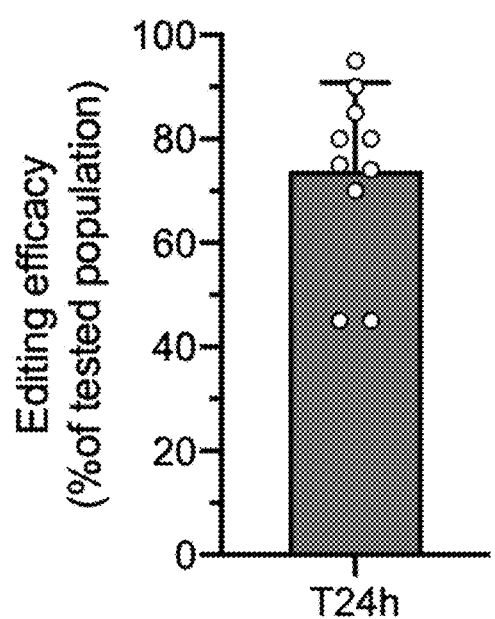
FIG. 14 displays histograms showing adenine base editing of β-lactamase after packaged phagemid transduction into *E. coli* in ten oligoMM mice using a non-replicative payload based on a primase-helicase. Delivery and editing efficiency of adenine base editing in vivo. The packaged phagemid titer for the in vivo experiment was $1.5*10^{10}$ tu/µl. Stool samples were analysed 24h post transduction. Cells were plated on streptomycin and streptomycin/carbenicillin in order to analyse editing efficiency (20 colonies per mouse). Editing of the active site of β-lactamase (K71) resulted in a loss of cell growth on carbenicillin plates. After 24 hours, base editing efficacy was ~75% of the whole population on average.

An *E. coli* strain carrying the β-lactamase gene in the genome was orally administered to 10 female mice aged 7 weeks at $10^7$ CFU per mouse. A packaged phagemids dose of $1.5 \times 10^{12}$ to (ie 100 µl, buffered with 100 µl of sucrose bicarbonate) was orally administered to the mice (T0). Stool samples were collected immediately before this administration, as well as 24 hours after (T24h). Stool homogenates were plated on selective medium, and individual clones were further repatched on agar plates with or without carbenicillin in order to analyse editing efficiency (20 colonies per mouse and per time point). Editing of the active site of β-lactamase (K71E) resulted in a loss of bacterial growth on carbenicillin plates. At T24h, ~75% of the whole population was base-edited on average (see FIG. 14).

Example 14—Prime Editing of β-Lactamase on the *E. coli* Genome after Phagemid Transduction In Vitro This example presents a method for the prime editing of the nucleic acid sequence encoding the Red Fluorescent Protein RFP (SEQ ID NO: 2314) on the *E. coli* genome after transduction with a DNA payload. The payload (SEQ ID NO: 2325) encodes a prime editor (PE), a transcribed prime editing guide RNA (pegRNA) under the inducible promoter pBetI, a lambda packaging sequence, a chloramphenicol resistance marker, and a p15A origin of replication. The pegRNA consists of an extended single guide RNA containing a primer binding site and a reverse transcriptase sequence in order to replace RFP's amino acid E16 (GAA) with a stop codon (TAA) on the bacterial genome.

The prime editor was engineered to insert a stop codon at position E16 of the target gene RFP resulting in a loss of red fluorescence.

Production of packaged phagemids comprising an A8 gpJ protein and a p2 STF protein for delivery into *E. coli* MG1655, resulted in titers of $2.6 \times 10^7$ transduction units per µl (tu/µl).

The fluorescence of colonies was analyzed by flow cytometry after overnight selection on chloramphenicol and 10 mM choline chloride and repatching on chloramphenicol plates. The genomic RFP was amplified from non-fluorescent colonies and the resulting PCR fragments were sequenced and the editing efficiency calculated. The stop codon was present in one of these individual colonies confirming successful prime editing after phagemid transduction.

Example 15—Editing of *E. faecalis, E. Faecium* and/or *L. brevis* Expressing Tyrosine Decarboxylase for Preventing L-DOPA Inactivation when Treating Subjects Suffering from Parkinson's Disease In recent years, it was shown that the microbial decarboxylases that are part of gut microbial organisms appear to be able to metabolise L-DOPA (levodopa). Novel bacterial L-DOPA metabolism by tyrosine decarboxylases (tyrDCs) has been identified, dominantly driven by *Enterococcus faecalis* (Maini Rekdal et al. Science 2019; 364) but also *E. faecium* and *L. brevis*. Mutating these tyrDCs in *E. faecalis, E. faecium* and/or *L. brevis* can block this bacterial L-DOPA-to-dopamine metabolism, thereby improving drug efficacy.

A method to prevent the expression of a functional tyrosine decarboxylase of *Enterococcus faecalis, E. faecium* and/or *L. brevis* by in situ genetic modification of the gene sequence encoding said tyrosine decarboxylase is described below.

A phagemid is generated containing a phage packaging site, a base editor enzyme containing a dCas9 or nCas9 fused to a deaminase domain for inducing genetic modifications or a prime editor enzyme containing a dCas9 or nCas9 fused to a reverse transcriptase domain for inducing genetic modifications, and a transcribed guideRNA targeting the catalytic site of tyrosine decarboxylase. The guideRNA is designed to introduce a stop codon in the catalytic site of said enzyme, rendering it inactive.

Packaged phagemids are produced following a standard thermal induction protocol[26].

The phagemid contacts the bacterial population resulting in at least one mutation resulting a stop codon in the catalytic site of tyrosine decarboxylase.

Treating patients suffering from Parkison's disease with L-DOPA in combination with such packaged phagemids leads to a better efficacy of L-DOPA.

Example 16—Editing of *Clostridium sporogenes* Expressing DHPAA Synthase for Preventing L-DOPA Deamination when Treating Subjects Suffering from Parkinson's Disease Levodopa is absorbed in the small intestine, however, 9-10% of unabsorbed "residual" L-dopamine is metabolised further down in the gut (this percentage increases with age and administered drug dose). The metabolite that results from this reaction—DHPPA—affects gut motility and constipation. This deamination can be mediated by *Clostridium sporogenes* which expresses DHPAA synthase. Constipation is a known side effect of Levodopa and inhibitors of this deamination could be beneficial.

A method to prevent the expression of a functional DHPAA synthase of *C. sporogenes* by in situ genetic modification of the gene sequence encoding said DHPAA synthase is described below.

A phagemid is generated containing a phage packaging site, a base editor enzyme containing a dCas9 or nCas9 fused to a deaminase domain for inducing genetic modifications or a prime editor enzyme containing a dCas9 or nCas9 fused to a reverse transcriptase domain for inducing genetic modifications, and a transcribed guideRNA targeting the catalytic site of DHPAA synthase The guideRNA is designed to introduce a stop codon in the catalytic site of said enzyme, rendering it inactive.

Packaged phagemids are produced following a standard thermal induction protocol[26].

The phagemid contacts the bacterial population resulting in at least one mutation resulting in a stop codon in the catalytic site DHPAA synthase.

Treating patients suffering from Parkison's disease with L-DOPA in combination with such packaged phagemids leads to reduced side effects, in particular reduced constipation.

TABLE 1

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 19 | AAAKHLTPV | *Pseudomonas putida* | Q84DC3 | P51648 |
| 20 | AACEAAVGL | *Desulfovibrio desulfuricans* | B8J1D0 | P03901 |
| 21 | AAGMNAAVR | *Lactobacillus salivarius* | Q1WTT3 | Q01813 |
| 22 | AAHGNSLRGI | *Parabacteroides distasonis, Porphyromonas gingivalis, Porphyromonas gingivalis* | A6L9K8, B2RHB7, Q7MXP1 | P15259 |
| 23 | AALGSDTGGS | *Lactobacillus casei, Lactobacillus casei, Lactobacillus johnsonii, Lactobacillus gasseri, Lactobacillus acidophilus, Lactobacillus helveticus, Lactobacillus delbrueckii, Lactobacillus delbrueckii, Eubacterium eligens, Campylobacter fetus, Helicobacter pylori, Neisseria meningitidis, Neisseria gonorrhoeae, Neisseria gonorrhoeae, Neisseria meningitidis, Neisseria meningitidis, Pediococcus ntosaceus* | B3WD57, Q03AC0, Q74152, Q041KS, Q5FLL1, A8YTZ6, Q04BV7, Q1GBF4, C4Z3J4, A0RNK4, Q9ZL13, Q9JYZ9, Q5F8U8, B4RM85, A1KUH8, A9M003, Q03EG5 | Q9H0R6 |
| 24 | AAPFGGVKQSG | *Rhizobium* sp. | P55653 | Q3SY69 |
| 25 | AAPGSKTTQ | *Aeromonas salmonicida, Aeromonas hydrophila, Citrobacter koseri, Enterobacter* sp., *Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Klebsiella pneumoniae, Klebsiella pneumoniae* | A4SMI9, A0KKI5, A8AFL6, A4WBJ4, Q0TGZ7, Q8FGS9, Q1RAV2, A1ACO0, B7MBP2, B7USL2, P76273, B1XHA3, C4ZZJ2, B6IBR3, B7M2B1, B7MVW5, B7L7N7, A7ZMV8, B7NBI3, B1LD37, B7NS84, B5YQX9, Q8XCL9, B7LPL0, B1J0Q3, A8A133, A6TB06, B5X035 | Q08J23 |
| 26 | AAPGTIRGD | *Parabacteroides distasonis* | A6LCB6 | O00746 |
| 27 | AAPGTIRGDF | *Streptococcus uberis, Streptococcus thermophilus, Streptococcus thermophilus* | B9DSE2, Q5M011, Q5M4M4 | O00746 |
| 28 | AAVEMRDNP | *Enterobacter* sp., *Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii* | A4W6W8, Q1RFU0, Q0TL85, A1A7U2, Q47155, B1J100, A7ZHZ2, P59477, A7ZWJ6, Q8X7Q1, P58963 | Q9UBT6 |
| 29 | AAVPSGASTG | *Clostridium botulinum, Clostridium botulinum, Clostridium botulinum, Clostridium botulinum, Clostridium botulinum, Clostridium botulinum* | C1FQW6, A7FQP0, B1IDB9, A7G9Y3, B1KTJ8, C3KZ49 | P06733 |
| 30 | ACGTSYHAG | *Listeria innocua, Listeria monocytogenes, Listeria monocytogenes, Pseudomonas putida, Pseudomonas syringae* | Q92DS8, Q722H1, Q8Y915, Q88BX8, Q87TT8 | Q06210 |
| 31 | ADFIGKQAL | *Listeria innocua* | Q92C06 | Q9UI17 |
| 32 | ADIGWITGH | *Helicobacter pylori, Helicobacter acinonychis, Helicobacter pylori* | B5Z6E9, Q17WR1, O25686 | Q9NUB1 |
| 33 | ADIITPNQFE | *Corynebacterium diphtheriae* | Q6NG19 | O00764 |
| 34 | ADIVTTTTHKTLRG | *Lactobacillus acidophilus* | Q5FMC0 | P34897 |
| 35 | ADVGLVGFP | *Corynebacterium urealyticum, Leuconostoc mesenteroides, Leuconostoc citreum* | B1VGL9, Q03YT6, B1N057 | A4D1E9 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 36 | ADVGLVGFPN | Desulfitobacterium hafniense, Desulfitobacterium hafniense, Clostridium tetani | B8FUR9, Q24SP0, Q892N8 | A4D1E9 |
| 37 | ADVGLVGFPNAGKS | Bacteroides thetaiotaomicron, Parabacteroides distasonis, Bacteroides vulgatus, Bacteroides fragilis, Bacteroides fragilis, Porphyromonas gingivalis, Porphyromonas gingivalis | Q89ZI9, A6LD68, A6L100, Q64XA5, Q5LGG9, Q7MW55, B2RIY7 | A4D1E9 |
| 38 | ADYLWNVSSPNT | Kocuria rhizophila, Streptomyces coelicolor, Streptomyces griseus, Streptomyces avermitilis | B2GHT4, Q9KXR7, B1W464, Q827Q6 | Q02127 |
| 39 | AEAYDVLSDP | Porphyromonas gingivalis, Porphyromonas gingivalis | Q9XCA6, B2RLJ0 | P59910 |
| 40 | AEDYHQQYL | Corynebacterium efficiens, Corynebacterium glutamicum, Corynebacterium glutamicum, Corynebacterium melassecola | Q8FLU6, Q8NLL5, A4QHY3, Q9APY4 | Q9UJ68 |
| 41 | AEIETDKAT | Rhizobium meliloti, Rhizobium meliloti | Q9R9N3, Q9R9N4 | P10515 |
| 42 | AESGWDFSSRW | Ralstonia solanacearum | Q8XT38 | O43280 |
| 43 | AESWDNVGLL | Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus | Q8CSD9, Q5HNY9, Q6G907, Q8NWB9, P67273, P67272, Q5HFK1, Q6GGE0 | Q9GZT8 |
| 44 | AETEAQRRQA | Methylobacterium sp. | B0UJI9 | Q969Y2 |
| 45 | AFDRILASRMG | Haemophilus influenzae, Haemophilus influenzae, Haemophilus influenzae | P43863, A5UD89, Q4QLS8 | Q01813 |
| 46 | AFDRILASRMGV | Haemophilus parasuis | B8F8G9 | Q01813 |
| 47 | AFGFMTRVA | Ralstonia pickettii | B2UGY6 | P61457 |
| 48 | AFGFMTRVAL | Ralstonia solanacearum | Q8XU38 | P61457 |
| 49 | AFLTVSGQL | Enterobacter sp., Haemophilus ducreyi | A4W8U9, Q7VLL7 | Q96I59 |
| 50 | AFMLPVATPPNAIVF | Haemophilus influenzae | Q57486 | Q86YT5 |
| 51 | AGAESGWDFSSRWL | Pseudomonas aeruginosa | Q9I165 | O43280 |
| 52 | AGAMENWGLVTYRE | Lactobacillus helveticus, Lactobacillus delbrueckii | Q10730, P37896 | P15144 |
| 53 | AGASLVQLY | Pseudomonas stutzeri, Pseudomonas fluorescens, Pseudomonas fluorescens | A4VM41, Q4KFI7, C3K017 | Q02127 |
| 54 | AGASLVQLYT | Akkermansia muciniphila | B2UNA2 | Q02127 |
| 55 | AGDGTTTAT | Clostridium botulinum, Clostridium tetani, Clostridium novyi, Desulfovibrio alaskensis, Desulfovibrio vulgaris, Desulfovibrio vulgaris | Q8KJ24, Q891G4, A0Q2T1, Q30YH6, A1VCQ0, Q72AL6 | P10809 |
| 56 | AGDGTTTATVL | Streptococcus agalactiae, Streptococcus agalactiae, Streptococcus agalactiae | Q8CX00, Q3JYQ0, Q8CX22 | P10809 |
| 57 | AGDGTTTATVLA | Aeromonas salmonicida, Aeromonas hydrophila, Aggregatibacter actinomycetemcomitans, Bacillus licheniformis, Bacillus clausii, Bacillus methylotrophicus, Bacillus pumilus, Bacillus halodurans, Campylobacter lari, Campylobacter jejuni, Campylobacter jejuni, Campylobacter jejuni, Campylobacter jejuni, Campylobacter jejuni, Campylobacter hominis, Campylobacter concisus, Citrobacter koseri, Edwardsiella ictaluri, Enterobacter asburiae, Enterobacter agglomerans, Enterobacter aerogenes, Enterobacter sp., Escherichia coli, Escherichia coli, Escherichia coli, Escherichia coli, Escherichia coli, | A4SR80, A0KGL1, P46398, Q65MZ8, Q5WJN4, A7Z207, A8FAG3, O50305, B9KCR7, A1W0K4, O69289, Q5HTP2, A8FMS6, A7H2F8, A7I0W5, A7ZCV2, A8AMQ6, C5BDK5, O66190, O66200, Q66198, A4W5N8, Q19NJ4, Q1R3B6, B1LQG4, B61615, B7NG81, B1ITQ5, P0A6F5, A8A7N9, P0A6F6, B7MSV9, B1XDP7, C5A1D5, B5Z2F2, B7M804, | P10809 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter lovleyi, Haemophilus influenzae, Haemophilus influenzae, Haemophilus influenzae, Haemophilus influenzae, Haemophilus parasuis, Haemophilus somnus, Haemophilus ducreyi, Helicobacter pylori, Helicobacter pylori, Helicobacter pylori, Helicobacter pylori, Helicobacter pylori, Helicobacter pylori, Helicobacter acinonychis, Klebsiella oxytoca, Klebsiella pneumoniae, Klebsiella pneumoniae, Kluyvera intermedia, Listeria welshimeri, Listeria monocytogenes, Listeria monocytogenes, Listeria monocytogenes, Listeria innocua, Neisseria flavescens, Proteus mirabilis, Pseudomonas syringae, Pseudomonas savastanoi, Pseudomonas syringae, Pseudomonas fluorescens, Pseudomonas fluorescens, Pseudomonas putida, Pseudomonas fluorescens, Pseudomonas aeruginosa, Pseudomonas putida, Pseudomonas putida, Pseudomonas putida, Pseudomonas aeruginosa, Pseudomonas aeruginosa, Pseudomonas aeruginosa, Ralstonia solanacearum, Raoultella ornithinolytica, Raoultella planticola, Rhizobium etli, Rhizobium etli, Rhizobium meliloti, Rhizobium meliloti, Rhizobium leguminosarum, Rhizobium leguminosarum, Rhizobium etli, Rhizobium meliloti, Rhizobium leguminosarum, Rhizobium leguminosarum, Rhizobium etli, Rhizobium meliloti, Rhizobium leguminosarum, Rhizobium leguminosarum, Rhizobium leguminosarum, Stenotrophomonas maltophilia, Stenotrophomonas maltophilia* | B7NTK2, P0A6F7, B7LCO2, B7MKU8, B7UPW3, A7ZV12, A1AJ51, Q0T9P8, B3E8G0, A5U9V2, A5UH48, P43733, Q4QN05, B8F865, Q0I284, P31294, Q9ZN50, B2UW12, P42383, B6JPA7, Q1CVE5, B5Z6D1, Q17VC6, O66210, B5Y368, A6TH53, O66192, A0AKH5, Q9AGE6, Q71XU6, C1KX21, B8DH59, Q929V0, P48215, B4EXE2, Q4ZP20, Q48EI5, Q87X14, Q3K7L6, C3K1A0, B0KFQ2, Q4K764, A6VB57, B1J3K5, A5W8M6, Q88N55, Q02H55, P30718, B7UZG3, Q8Y1P8, O66214, O66212, Q2KAU2, Q2JYW6, P35470, P35471, Q1M3H2, Q9L691, Q2KBZ7, P35469, B5ZRD6, Q1MKX4, Q2KAR0, Q930Y0, Q9L690, P34939, Q1MJF2, B2FIU9, B4SKL8 | |
| 58 | AGEFTRRAF | *Sphingomonas wittichii* | A5VA82 | Q969Y2 |
| 59 | AGFSGHGFK | *Bacillus sp., Bacillus sp.* | P23342, P40859 | Q9P0Z9 |
| 60 | AGGQGTRLG | *Staphylococcus saprophyticus, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis* | Q49ZB5, Q4L846, Q6GEQ8, Q7A0A0, Q6G7E3, Q7A4A4, Q99S95, Q2FEW1, Q5HE34, Q2FW81, Q2YYH4, Q5HM59, Q8CNG6 | Q16222 |
| 61 | AGGRYDGLV | *Aeromonas salmonicida, Aeromonas hydrophila, Enterobacter sp.,* | A4SP01, A0KJ45, A4WD92, B6I586, | P12081 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Proteus mirabilis, Pseudomonas fluorescens, Pseudomonas fluorescens, Pseudomonas syringae, Pseudomonas fluorescens, Pseudomonas putida, Pseudomonas putida, Pseudomonas putida, Pseudomonas syringae, Pseudomonas savastanoi, Pseudomonas putida, Streptococcus pneumoniae, Streptococcus pneumoniae, Streptococcus pneumoniae, Streptococcus pneumoniae, Streptococcus sanguinis, Streptococcus pneumoniae, Streptococcus pneumoniae, Streptococcus pneumoniae, Streptococcus gordonii, Streptococcus pneumoniae, Streptococcus pneumoniae, Streptococcus pneumoniae, Streptococcus suis, Streptococcus suis, Streptococcus pneumoniae, Streptococcus uberis, Streptococcus agalactiae, Streptococcus agalactiae, Streptococcus agalactiae, Streptococcus equi | Q1R8L9, B1LNG9, P60906, B1IWE7, P60907, Q0TEX1, A1AE52, A8A320, B7M7L8, B1XAY9, C4ZX89, B7MYE9, B7NRG4, P60908, B5Z0Y3, B7MHZ9, A7ZPV7, B7LCQ4, B7UGW0, B7N6A2, B5XNL6, B4EZT2, Q3K7B7, C3K1L3, Q4ZX22, Q4K6V0, Q88PJ6, B0KPI8, A5VYT6, Q886Y9, Q48LZ3, B1JDV7, Q8DN46, B8ZPP6, Q04I50, C1CU26, A3CR40, C1CH52, Q97NC9, B1I9T7, A8AZV0, B5E3C8, C1CAV1, C1CNA0, A4VT07, A4VZ92, B2IN41, B9DW81, Q3JYL6, P67486, P67485, C0MGD4 | |
| 62 | AGGRYDGLVG | Acinetobacter baumannii, Acinetobacter baumannii, Acinetobacter baumannii, Acinetobacter baumannii, Acinetobacter baylyi | B7I5G8, B0VKR7, B7H068, B0V5G6, Q6FEM2 | P12081 |
| 63 | AGGVTVSYFEW | Bacillus subtilis, Bacillus subtilis | P50735, P39633 | P49448 |
| 64 | AGIMITASHNPK | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Staphylococcus haemolyticus | Q6GDU9, Q7A3K7, Q99RE2, Q5HD61, Q2FVC1, Q2FE11, Q8NUV4, Q6G6I3, Q2YW66, Q49WH7, Q4L9R5 | Q96G03 |
| 65 | AGKLHTGRSRNDQV | Lactobacillus reuteri, Lactobacillus reuteri | A5VJH2, B2G6Y7 | P04424 |
| 66 | AGLAVRDVSELTGFPE | Rhizobium loti | Q98E57 | P31939 |
| 67 | AGLKEGDYI | Bacillus subtilis | O31754 | Q8TCX5 |
| 68 | AGNWTGEMVEELILSGADI | Aeromonas hydrophila, Aeromonas salmonicida | A0KN65, A4SJY8 | P36959 |
| 69 | AGTIAGLNV | Campylobacter fetus, Helicobacter pylori, Helicobacter pylori, Helicobacter pylori, Helicobacter pylori, Helicobacter pylori, Helicobacter pylori | A0RPW7, P55994, B6JPL0, Q1CV46, B5Z9P0, B2URT8, Q9ZMW4 | P11021 |
| 70 | AGVMITASHN | Lactobacillus reuteri, Lactobacillus reuteri, Lactobacillus brevis, Pediococcus ntosaceus | B2G638, A5VIK4, Q03SJ3, Q03GV0 | Q6PCE3 |
| 71 | AGVPRKPGM | Methylobacterium sp., Methylobacterium extorquens, | B0UCF0, B7KVX2, A9W386, B8IJB4, | P40926 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Methylobacterium extorquens, Methylobacterium nodulans, Methylobacterium extorquens, Methylobacterium radiotolerans, Methylobacterium populi, Rhizobium meliloti, Rhizobium sp., Rhizobium etli, Rhizobium etli | Q84FY8, B1LZN1, B1ZG93, Q9EYJ6, C3M9U0, B3PQ91, Q2K3E9 | |
| 72 | AGVTVVIVR | Neisseria gonorrhoeae, Neisseria meningitidis, Neisseria meningitidis, Neisseria meningitidis | Q5F7A0, O34370, P57007, A1KV48 | Q9Y617 |
| 73 | AGVTVVIVRDDL | Lactobacillus helveticus | A8YW78 | Q9Y617 |
| 74 | AGYITPVPGGVGPMT | Ralstonia pickettii | B2UFY4 | P13995 |
| 75 | AHGNSLRGI | Bacteroides fragilis, Bacteroides fragilis, Bacteroides thetaiotaomicron, Bacteroides thetaiotaomicron | Q5LAT7, Q64R85, Q8A8R2, Q8A765 | P15259 |
| 76 | AHGTNPASA | Uncultured termite | B1GYV8 | P23378 |
| 77 | AHIDAGKTTTTER | Aeromonas salmonicida | A4SHV8 | Q969S9 |
| 78 | AHIDAGKTTTTERIL | Arcobacter butzleri, Neisseria meningitidis, Neisseria meningitidis, Neisseria meningitidis, Neisseria meningitidis, Neisseria gonorrhoeae, Neisseria gonorrhoeae | A8EW86, Q9JX07, A1KRH0, A9M3X0, Q9K1I8, Q5F553, B4RQX2 | Q969S9 |
| 79 | AHLGHVFPDGP | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Klebsiella pneumoniae, Klebsiella pneumoniae, Pseudomonas putida, Pseudomonas entomophila, Pseudomonas syringae, Pseudomonas fluorescens, Pseudomonas putida, Pseudomonas fluorescens, Pseudomonas syringae, Pseudomonas savastanoi, Pseudomonas fluorescens, Pseudomonas putida, Pseudomonas putida, Pseudomonas mendocina, Pseudomonas aeruginosa, Pseudomonas aeruginosa, Pseudomonas aeruginosa, Pseudomonas aeruginosa, Rhizobium meliloti | B7M1J2, B1IPF3, A8A0X0, B7MVQ9, B6IBJ9, B1LDV3, B7N5B4, C4ZZD4, P0A746, Q0TH50, B7L603, P0A747, B1XGN8, B5YQ71, B7NSZ8, P0A748, B7USF8, A7ZMP8, B7MAY9, B7LQ21, B5XS71, A6T7R0, B1J4W5, Q1ID16, Q4ZQC6, Q4K8U5, B0KUQ0, C3K735, Q885Q1, Q48FR2, Q3K935, Q88LQ6, A5W756, A4XVB1, Q91016, Q02NZ0, B7UUZ9, A6V3R3, Q92RA4 | Q9Y3D2 |
| 80 | AHVDHGKTTL | Bacillus subtilis, Escherichia coli, Escherichia coli, Escherichia coli, Escherichia coli, Haemophilus influenzae, Helicobacter pylori, Helicobacter pylori | O07631, P32132, P0A3B3, P0A3B1, P0A3B2, P44910, Q9ZLZ3, O25225 | Q7Z2Z2 |
| 81 | AIILATAGL | Bacillus cytotoxicus | A7GTE5 | P08397 |
| 82 | AIILATAGLQRMGW | Bacillus cereus, Bacillus cereus, Bacillus thuringiensis, Bacillus anthracis, Bacillus anthracis, Bacillus anthracis, Bacillus cereus, Bacillus thuringiensis, Bacillus cereus, Bacillus cereus, Bacillus cereus, Bacillus cereus, Bacillus cereus, Bacillus cereus, Bacillus weihenstephanensis | B7JQ57, C1ETR0, A0RJ81, C3L6Z5, Q81LC7, C3P9E9, Q72ZW2, Q6HD62, B7IIX5, Q633Y0, Q817R0, B7HE96, B9IZ39, B7HQM4, A9VIT8 | P08397 |
| 83 | AIKWNFTKF | Bacillus subtilis | P52035 | P36969 |
| 84 | AIVNAANSSL | Fusobacterium nucleatum | Q8RHQ2 | Q9B069 |
| 85 | AIYDTMQYI | Desulfitobacterium hafniense, Eubacterium eligens, Clostridium botulinum, Clostridium botulinum, Clostridium botulinum, Clostridium botulinum, Clostridium botulinum, Clostridium botulinum, Clostridium kluyveri, Clostridium kluyveri, Clostridium botulinum, | Q24S49, C4Z1T6, A7FYI2, A7GIH2, B1IND7, C1FLA6, A5I6W1, B9E685, A5N2K8, B1L1D7, B2TPB9, B2UX13, A0Q2L1, Q891J7, | Q16740 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Clostridium botulinum, Clostridium botulinum, Clostridium novyi, Clostridium tetani, Clostridium perfringens, Clostridium perfringens, Clostridium perfringens | Q0ST53, Q8XKK1, Q0TQK2 | |
| 86 | AKALALGAS | Helicobacter pylori | Q9ZL14 | P12268 |
| 87 | AKEMHVGHLRS | Neisseria meningitidis, Neisseria meningitidis, Neisseria meningitidis, Neisseria gonorrhoeae, Neisseria gonorrhoeae, Streptomyces griseus, Streptomyces avermitilis, Streptomyces coelicolor | Q9JYM8, A1KUU4, Q9JTM7, B4RL22, Q5F835, B1VTB7, Q82E68, Q9WX29 | P54136 |
| 88 | AKEMHVGHLRSTIIG | Pseudomonas entomophila, Pseudomonas putida | Q1IGB8, B1J2I3 | P54136 |
| 89 | AKKVLSVAVYNHYKRI | Lactobacillus gasseri, Lactobacillus helveticus, Lactobacillus johnsonii | Q042T7, A8YUS4, Q74JU4 | O76031 |
| 90 | AKNTYGTGCF | Bacillus weihenstephanensis, Bacillus thuringiensis, Bacillus cereus, Bacillus cereus, Bacillus anthracis, Bacillus cereus, Bacillus cereus, Bacillus thuringiensis, Bacillus cytotoxicus, Bacillus cereus, Bacillus anthracis, Bacillus anthracis, Bacillus cereus, Bacillus halodurans, Ralstonia pickettii | A9VI58, Q6HMD5, B7HYU3, B7JCV9, C3LCY4, Q63EX2, C1EKE4, A0RAP3, A7GLY7, B9IT52, Q81U58, C3P2T3, Q73CE0, Q9KDW8, B2UF87 | Q14409 |
| 91 | AKNTYGTGCFLL | Eubacterium rectale, Clostridium botulinum, Clostridium botulinum, Desulfovibrio desulfuricans, Geobacter metallireducens, Listeria monocytogenes, Listeria monocytogenes, Listeria monocytogenes, Listeria welshimeri, Listeria innocua | C4ZGB4, B2TN12, B2V358, B8JOH2, Q39V17, Q8Y6Z2, B8DHL0, Q71ZD2, C1KVI5, A0AIY7, Q92BH6 | Q14409 |
| 92 | AKRLCPQLI | Bacillus cereus, Bacillus anthracis | Q635E0, Q81M86 | Q9UBT6 |
| 93 | ALAAGNCVV | Citrobacter koseri, Enterobacter sp. | A8AGJ9, A4WAR9 | P43353 |
| 94 | ALAAGNCVVLKPSEI | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli | B6IAI9, B7LZ33, A7ZLN7, B1IS15, A8A002, B7URJ0, P77674, B1XDF5, C4ZVI3, Q1RBX3, Q8FHK7, Q0THX6, A1AB46, B7MUN0, B7MMS8, B1LFH3, B7L6F9, B7LR95, B7N4K1, B5Z0W0, Q8X9W5 | P43353 |
| 95 | ALAAIFIAQ | Bacillus caldotenax | P24944 | P43003 |
| 96 | ALEKIRAGA | Rhizobium leguminosarum, Rhizobium leguminosarum, Rhizobium etli, Rhizobium etli | B5ZPH6, Q1MLT8, B3PNN8, Q2KCS8 | Q02127 |
| 97 | ALEYGLPPT | Fusobacterium nucleatum | Q8RG52 | Q15046 |
| 98 | ALEYGLPPTAG | Acinetobacter baumannii, Acinetobacter baumannii, Acinetobacter baumannii, Acinetobacter baumannii, Acinetobacter baylyi | B0VSE0, B0V9L5, B7GXW0, A3M3D6, Q43990 | Q15046 |
| 99 | ALFGTIDSWL | Methylobacterium extorquens, Methylobacterium extorquens, Methylobacterium populi | B7KN92, A9W8T7, B1ZGW7 | Q14409 |
| 100 | ALGSDTGGS | Lactobacillus plantarum, Eubacterium rectale | Q88XP7, C4ZHB9 | Q9H0R6 |
| 101 | ALKAADVGI | Bacillus subtilis | O31688 | Q9NQ11 |
| 102 | ALKPMNCPGH | Ralstonia pickettii, Stenotrophomonas maltophilia | B2UGJ8, B4SQH4 | A2RTX5 |
| 103 | ALKYHPDKN | Clostridium tetani | Q892R1 | O75953 |
| 104 | ALQTREQHI | Bacteroides thetaiotaomicron, Bacteroides fragilis, Bacteroides fragilis | Q8A8M0, Q5LDN2, Q64UQ7 | P23378 |
| 105 | ALQTREQHIRR | Pseudomonas stutzeri, Pseudomonas putida | A4VRT4, Q88CI9 | P23378 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 106 | ALREAQEEV | Citrobacter koseri, Enterobacter aerogenes, Klebsiella pneumoniae, Klebsiella pneumoniae | A8AFP5, P43338, B5XQ60, A6TAY4 | P00O24 |
| 107 | ALRNRSNTP | Haemophilus parasuis, Proteus mirabilis, Rhizobium etli, Rhizobium etli, Rhizobium leguminosarum | B8F632, B4EYR8, Q2KCY8, B3Q0A9, B5ZNS9 | P06744 |
| 108 | ALRNRSNTPI | Edwardsiella ictaluri | C5B6Z1 | P06744 |
| 109 | ALVGPNGAGKS | Streptomyces coelicolor | Q9RKQ4 | Q9UG63 |
| 110 | ALVTGASGGIG | Rhizobium sp. | P72332 | Q6UWP2 |
| 111 | AMEGPTPVSAL | Streptomyces coelicolor | Q9XAR5 | P03915 |
| 112 | AMLACARIGA | Pseudomonas syringae, Pseudomonas syringae, Pseudomonas savastanoi, Pseudomonas putida, Pseudomonas stutzeri, Rhizobium sp., Rhizobium meliloti, Streptomyces avermitilis | Q885K7, Q4ZQG8, Q48G09, Q88EH6, A4VKA0, C3MAS0, Q92KX2, Q82EL5 | Q9NUB1 |
| 113 | AMLACARIGAVH | Citrobacter koseri, Escherichia coli, Escherichia coli, Escherichia coli, Pseudomonas aeruginosa, Rhizobium etli, Rhizobium leguminosarum, Rhizobium etli | A8AN29, Q8FAY8, Q8X5T5, P27550, Q9HV66, B3PS41, B5ZV36, Q2K2T1 | Q9NUB1 |
| 114 | AMLTTFNEIDM | Staphylococcus saprophyticus | Q49XM4 | P36957 |
| 115 | AMVGDGIND | Bacillus subtilis | O32220 | Q04656 |
| 116 | ANASLLDEGTAAAEA | Akkermansia muciniphila, Pseudomonas fluorescens | B2UNH4, Q4K7Q8 | P23378 |
| 117 | ANDPDADRLAVA | Haemophilus influenzae | Q57290 | Q96G03 |
| 118 | ANFAVYTAL | Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae | A8AD38, C5BEV2, A4WDC0, B1LNK7, Q1R814, B6I5C4, P0A825, A8A359, B1IV56, P0A826, Q0TET8, B1X1326, A1AE82, C4ZXC6, B7M8A7, B7MYI0, B7NRK2, B7LDE3, B7MIN5, A7ZPZ4, B7UGZ1, B5Z123, Q8XA55, B7N6D8, A6TCG5, B5XNI6 | P34896 |
| 119 | ANFLDVGGGA | Campylobacter hominis | A7I2F2 | Q9P2R7 |
| 120 | ANGPTTPEA | Staphylococcus aureus, Staphylococcus aureus, Staphylococcus aureus, Staphylococcus aureus, Staphylococcus aureus, Staphylococcus aureus | Q7A1B9, Q6GID0, Q6GAW8, Q99VD0, Q7A6H8, Q5HHC7 | P49448 |
| 121 | ANGPTTPEAD | ptoclostridium difficile | P27346 | P49448 |
| 122 | ANMDTVGTF | Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Klebsiella pneumoniae, Klebsiella pneumoniae | C5B9H0, A4W6K6, Q8X984, B5YZD9, A7ZHJ5, Q0TLN6, B7M145, Q1RG92, B6HZ81, P60560, B1IQN5, P60561, B1XC80, C4ZRJ8, A7ZW55, A1A7E7, B7MAM6, B7LFX2, B7UIF3, B7N7X5, B7NI65, B7MNW1, B1LG40, B7LWQ6, B5Y1T3, A6T4P6 | P36959 |
| 123 | ANMDTVGTFEMA | Citrobacter koseri | A8ALJ2 | P36959 |
| 124 | APALACGNA | Pseudomonas sp. | Q9KWS5 | P49189 |
| 125 | APGRVNLIGEHTDYN | Aeromonas hydrophila, Bacillus subtilis, Bacillus halodurans, Citrobacter koseri, Enterobacter sp., Escherichia coli, Escherichia coli, Escherichia coli, Escherichia coli, Escherichia fergusonii, Escherichia coli, Escherichia coli, Escherichia coli, Escherichia coli, Escherichia coli, | A0KQH8, P39574, Q9KDV4, A8AJ37, A4W899, B7MPP1, B1LM48, B7N9Z9, B7ULN0, B7LK02, B617R1, P0A6T3, B1IXX9, C4ZXS8, B7M6C0, B5YRF5, | P51570 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Proteus mirabilis, Streptomyces coelicolor | P0A6T4, B7LAF8, A7ZJD2, B7NNH9, Q1REH4, Q8FJS1, Q0TJU4, A1A900, B7MGL4, A7ZY13, B4F0A6, Q9K3S8 | |
| 126 | APGTGTPEI | Pseudomonas aeruginosa | Q9I6K2 | Q9BSE5 |
| 127 | APIFHVNADDPEAV | Escherichia coli, Escherichia coli, Escherichia coli | P0AFG3, P0AFG5, P0AFG4 | Q9ULD0 |
| 128 | APSDMMDGR | Clostridium josui | Q59295 | P13716 |
| 129 | APSPTGFLH | Lactobacillus reuteri, Lactobacillus reuteri, Listeria monocytogenes, Listeria monocytogenes, Listeria welshimeri, Listeria innocua | B2G868, A5VKT4, Q724H5, Q8YAB3, A0AF36, Q92F38 | Q5JPH6 |
| 130 | APTGSGKTLA | Escherichia coli | P30015 | Q9Y2R4 |
| 131 | APTRELAQQ | Bacillus cereus, Staphylococcus aureus | Q818H2, Q2FY15 | Q92841 |
| 132 | AQEALGDVV | Pseudomonas aeruginosa, Pseudomonas putida, Pseudomonas syringae | Q9HTX6, Q88CI8, Q88AR9 | P23434 |
| 133 | AQLSGGQKQR | Pseudomonas aeruginosa, Pseudomonas aeruginosa, Pseudomonas fluorescens, Pseudomonas fluorescens, Pseudomonas syringae, Pseudomonas syringae, Pseudomonas savastanoi, Streptomyces avermitilis | Q02ME3, Q9I1C8, Q4KK46, Q3KJS6, Q87UN4, Q4ZZR8, Q48PU6, Q827Y0 | Q2M3G0 |
| 134 | AQLSGGQKQRV | Pseudomonas savastanoi, Pseudomonas fluorescens, Pseudomonas syringae, Pseudomonas syringae, Streptomyces coelicolor | Q48PN3, Q3KK97, Q4ZZK0, Q87UV4, Q9L1C3 | Q9NP78 |
| 135 | AQSIGEPGTQ | Desulfovibrio alaskensis, Desulfovibrio vulgaris, Desulfovibrio vulgaris, Geobacter lovleyi, Geobacter bemidjiensis, Geobacter sp., Geobacter daltonii, Geobacter uraniireducens, Haemophilus influenzae, Haemophilus influenzae, Haemophilus influenzae, Haemophilus influenzae, Haemophilus ducreyi, Ralstonia solanacearum, Stenotrophomonas maltophilia | Q30X04, A1VAJ5, Q727C6, B3E7S9, B5EFP4, C6E4R3, B9M6V1, A5GAY2, Q40N34, A5U9X9, A5UH19, P43739, Q7VKL8, Q8XUZ9, B2FQ39 | O14802 |
| 136 | ARGLDYYTG | Bifidobacterium longum, Bifidobacterium longum, ifidobacterium animalis, Clostridium tetani, Stenotrophomonas maltophilia, Stenotrophomonas maltophilia | B7GPS9, Q8G864, B8DU04, Q892X7, B2FPL6, B4STN3 | P12081 |
| 137 | ARLNFSHGSHE | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus haemolyticus | Q6GG09, Q7A0N4, Q5HF76, Q6G8M9, Q2FXM9, Q99TG5, Q7A559, Q2FG40, Q2YTE3, Q8CS69, Q5HNK7, Q4L739 | P30613 |
| 138 | ARMTAMDNA | Clostridium cellulolyticum | B8I578 | P36542 |
| 139 | ARVYKQSDL | Campylobacter fetus | A0RR73 | P00480 |
| 140 | ASFITPVPGGVGPMT | Bacillus methylotrophicus, Bacillus subtilis | A7Z6J9, P54382 | P11586 |
| 141 | ASFITPVPGGVGPMTVA | Aeromonas hydrophila, Aeromonas salmonicida | A0KJD4, A4SNM0 | P11586 |
| 142 | ASFITPVPGGVGPTVAMLM | Haemophilus somnus | Q0I3S5 | P11586 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 143 | ASGAGGQHVN | Enterococcus faecalis | Q831F6 | Q9UGC7 |
| 144 | ASGPLVRSSY | Pseudomonas fluorescens, Pseudomonas aeruginosa, Pseudomonas putida, Pseudomonas fluorescens, Pseudomonas entomophila, Pseudomonas aeruginosa, Pseudomonas aeruginosa, Pseudomonas aeruginosa, Pseudomonas putida, Pseudomonas putida, Pseudomonas syringae, Pseudomonas syringae, Pseudomonas savastanoi, Pseudomonas stutzeri | C3K2L8, A6V0B4, B1J144, Q3K6A4, Q1I4G1, B7V9C1, Q9HX25, Q02SG3, Q88DM5, A5W9I5, Q87WV7, Q4ZN84, Q48DM6, A4VQZ6 | O43766 |
| 145 | ASKNASEMI | Geobacter lovleyi | B3EA02 | P36542 |
| 146 | ASKPLKGARI | Rhizobium meliloti | Q92TC1 | P23526 |
| 147 | ASLLDEGTAAAEA | Streptomyces avermitilis, Streptomyces coelicolor, Streptomyces griseus | Q827D7, Q9AK84, B1W4G3 | P23378 |
| 148 | ASLVHDDVIDDA | Bacillus subtilis | P31114 | Q5T2R2 |
| 149 | ATDIAARGLD | Bacillus subtilis | O34750 | Q13206 |
| 150 | ATDPDADRL | Bacillus subtilis | P18159 | Q6PCE3 |
| 151 | ATDVAARGLDI | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus haemolyticus, Staphylococcus epidermidis, Staphylococcus saprophyticus | Q6GEZ3, Q7A0D2, Q6G7M9, Q5HEB9, Q7A4G0, Q995H6, Q2FF45, Q2FWH5, Q2YUH3, Q8CRP6, Q4L7W0, Q5HME0, Q49Z29 | Q9GZR7 |
| 152 | ATIAFGMGI | Haemophilus influenzae | P71359 | P54132 |
| 153 | ATINYPFEKGP | Rhizobium etli, Rhizobium leguminosarum, Rhizobium leguminosarum | Q2K954, Q1MIK6, B5ZYM2 | O00217 |
| 154 | ATIQVYEETSG | Clostridium tetani | Q891P1 | P38606 |
| 155 | ATPKGYEPDA | Campylobacter curvus | A7GZL8 | P00480 |
| 156 | ATSGDTGSA | Pseudomonas aeruginosa | P29363 | Q8IY07 |
| 157 | ATVKGDVHDIGKNIV | Haemophilus influenzae | Q57195 | Q99707 |
| 158 | ATWQKLLD | Neisseria meningitidis | Q9JTZ5 | Q9H0R6 |
| 159 | ATWCGPCKMI | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus saprophyticus, Staphylococcus haemolyticus | Q6GA69, Q6GHU0, P0A0K5, P0A0K6, P99122, P0A0K4, Q5HGT9, Q2YXD0, Q2FZD2, Q2FHT6, Q8CPL5, Q5HQ29, Q49WR2, Q4L5F0 | P10599 |
| 160 | AVDTTGAGD | Klebsiella pneumoniae | P26420 | Q9H477 |
| 161 | AVGIDLGTT | Bifidobacterium longum, Bifidobacterium longum, Bifidobacterium animalis | Q8G6W1, B3DNP9, B8DT62 | P11142 |
| 162 | AVGKIVMEAAAK | Bacillus subtilis | P39616 | P51648 |
| 163 | AVGQGALGVE | Clostridium acetobutylicum | Q97MU4 | P08397 |
| 164 | AVGSDADIV | Rhizobium radiobacter | Q44184 | Q14117 |
| 165 | AVIHFAGLKAVGESV | Klebsiella pneumoniae | P45602 | Q14376 |
| 166 | AVITVPAYF | Corynebacterium efficiens, Corynebacterium aurimucosum, Finegoldia magna, Pediococcus ntosaceus | Q8FM78, C3PJM6, B0S1F8, Q03FR7 | P0DMV9 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 167 | AVITVPAYFND | Bacillus cytotoxicus, Bacillus cereus, Bacillus cereus, Bacillus cereus, Bacillus thuringiensis, Bacillus cereus, Bacillus cereus, Bacillus cereus, Bacillus anthracis, Bacillus cereus, Bacillus anthracis, Bacillus thuringiensis, Bacillus cereus, Bacillus anthracis, Bacillus cereus, Bacillus weihenstephanensis, Bacillus megaterium, Bacillus pumilus, Corynebacterium jeikeium, Streptomyces avermitilis | A7GT08, Q730M1, B9IY81, B7HPL3, Q6HDK7, Q634M7, Q818E9, B7HCU0, C3L5R7, C1ESK8, Q81L52, A0RIT3, B7JN39, C3P8M0, B7IYG7, A9VHU1, P05646, A8FFD2, Q4JXX6, Q826F6 | P0DMV9 |
| 168 | AVITVPAYFNDSQR | Campylobacter hominis | A7I2D4 | P17066 |
| 169 | AVITVPAYFNDSQRQATKDAG | Lactobacillus casei, Lactobacillus casei | Q038N3, B3WEQ7 | P0DMV9 |
| 170 | AWSLLDNFEW | Paenibacillus polymyxa | P22073 | Q9H227 |
| 171 | AWTTTPWTLP | Clostridium kluyveri | A5N3P1 | P41252 |
| 172 | AWTTTPWTLPSN | Bacteroides fragilis, Bacteroides fragilis, Bacteroides thetaiotaomicron, Clostridium novyi, Clostridium tetani, Clostridium perfringens, Clostridium acetobutylicum, Porphyromonas gingivalis | Q64U07, Q5LCU8, Q8A9K9, A0Q3B0, Q899C3, Q8XHE4, Q97E50, Q7MUD3 | P41252 |
| 173 | AWTTTPWTLPSNLA | Corynebacterium efficiens, Corynebacterium glutamicum | Q8FNV0, Q8NNP0 | P41252 |
| 174 | AYEIIKLKG | Lactobacillus casei | P00343 | P07864 |
| 175 | AYEPVWAIG | Pseudomonas stutzeri | A4VPP4 | P60174 |
| 176 | AYEPVWAIGTG | Bifidobacterium longum, Bifidobacterium longum, Bifidobacterium adolescentis, Pseudomonas putida, Pseudomonas putida, Pseudomonas putida, Pseudomonas fluorescens, Pseudomonas entomophila, Pseudomonas fluorescens, Pseudomonas aeruginosa, Pseudomonas putida, Pseudomonas aeruginosa, Pseudomonas aeruginosa, Pseudomonas aeruginosa, Pseudomonas syringae, Pseudomonas savastanoi, Pseudomonas syringae, Pseudomonas mendocina, Rhizobium meliloti, Rhizobium loti, Stenotrophomonas maltophilia, Stenotrophomonas maltophilia | B3DRW0, Q8G6D5, A1A1N2, B0KHY2, Q88DV4, A5W991, Q3KI88, Q1IF47, Q4KIF9, A6VCK5, B1J266, B7V1G0, Q9HV51, Q02FS4, Q87WQ1, Q48E73, P95576, A4XYE4, Q92QA1, Q98ME7, B4SQT8, B2FNY1 | P60174 |
| 177 | AYEPVWAIGTGK | Corynebacterium glutamicum, Corynebacterium efficiens, Corynebacterium glutamicum, Corynebacterium diphtheriae, Desulfovibrio vulgaris, Enterobacter sp., Enterobacter cloacae, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter bemidjiensis, Klebsiella pneumoniae, Neisseria meningitidis, Neisseria meningitidis, Streptomyces coelicolor, Streptomyces avermitilis | A4QEG0, Q8FT67, P19583, Q6NH37, B8DJI3, A4WG77, Q9Z6B9, B7NFL6, B7LVC6, P0A860, B7M6X0, B6I4R2, A7ZUD3, Q1R3Z9, Q0TAE5, A8A724, B1LNM2, B1X1385, P0A859, P0A858, B1IVG0, A1AI95, B5YZ57, B7NU88, B7MI51, B5EF41, Q7X222, Q9JW31, Q9JXT8, Q9Z520, Q829W1 | P60174 |
| 178 | AYEPVWAIGTGKTA | Geobacter lovleyi | B3E9Q8 | P60174 |
| 179 | AYEPVWAIGTGKTAT | Geobacter uraniireducens, Ralstonia solanacearum | A5G381, Q8XXP9 | P60174 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 180 | AYEPVWAIGTGKTATP | *Fusobacterium nucleatum*, Uncultured termite | Q8RDX7, B1GZW3 | P60174 |
| 181 | AYEVLSDPQ | *Clostridium thermocellum, Enterococcus faecalis, Geobacter sulfurreducens, Proteus mirabilis, Streptomyces coelicolor, Streptomyces avermitilis, Streptomyces albus* | A3DF24, Q835R5, Q74H58, B4F2V6, Q9RDD7, Q82BY4, O52164 | Q9NVH1 |
| 182 | AYNADFDGD | *Aeromonas salmonicida, Aeromonas hydrophila, Akkermansia muciniphila, Lactobacillus fermentum, Lactobacillus salivarius, Lactobacillus reuteri, Lactobacillus reuteri, Lactobacillus plantarum, Lactobacillus brevis, Bacillus pumilus, Lactobacillus helveticus, Bacillus methylotrophicus, Bacillus clausii, Bacillus weihenstephanensis, Lactobacillus acidophilus, Lactobacillus casei, Bacillus anthracis, Lactobacillus casei, Bacillus subtilis, Bacillus cytotoxicus, Bacillus halodurans, Bacillus cereus, Bacillus cereus, Bacillus thuringiensis, Bacillus thuringiensis, Bacillus cereus, Lactobacillus sakei, Bacillus licheniformis, Lactobacillus gasseri, Lactobacillus johnsonii, Lactobacillus delbrueckii, Lactobacillus delbrueckii, Desulfitobacterium hafniense, Citrobacter koseri, Clostridium thermocellum, Clostridium botulinum, Clostridium botulinum, Clostridium botulinum, Clostridium botulinum, ptoclostridium difficile, Clostridium botulinum, Clostridium kluyveri, Clostridium tetani, Clostridium novyi, Clostridium acetobutylicum, Clostridium beijerinckii, Clostridium botulinum, Clostridium botulinum, Enterobacter sp., Enterococcus faecalis, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Finegoldia magna, Klebsiella pneumoniae, Leuconostoc mesenteroides, Leuconostoc pseudomesenteroides, Leuconostoc citreum, Listeria innocua, Listeria monocytogenes, Listeria monocytogenes, Listeria welshimeri, Listeria grayi, Pediococcus acidilactici, Pediococcus ntosaceus, Pseudomonas aeruginosa, Pseudomonas aeruginosa, Pseudomonas aeruginosa, Pseudomonas stutzeri, Pseudomonas mendocina, Pseudomonas fluorescens, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus epidermidis,* | A4SHV0, A0KQA4, B2UQY1, B2GDX6, Q1WVA4, A5VLL3, B2G8Y5, Q88XZ2, Q03PV0, A8F977, A8YXJ9, A7ZON0, Q5WLR9, A9VP70, Q5FM96, B3WAM7, P77819, Q034X1, P37871, A7GK13, Q9Z9M1, Q73FA3, Q63H97, Q6HPR5, A0R8H3, Q81J47, Q38UQ3, Q65PB4, Q046D1, Q74L94, Q04C21, Q1GBM4, Q250N9, A8AKT8, A3DIZ5, B1IGG1, A5I7L3, A7FZ76, B1KSN2, Q18CF3, A7GJ81, A5N4P0, Q890N5, A0PXT9, Q97EH0, A6LPQ5, B2TIG9, B2UYA4, A4W5A8, Q82Z41, Q0TA77, B1IU0Q, P0A8T7, A8A787, P0A8T8, B1XBZ0, A7ZUK2, B1LNU0, Q1R5V4, A1AIG0, Q8FB83, B0S2E5, A6TGP1, P94892, P94899, B1MWV7, P77879, Q724E9, Q8YA96, A0AF64, P77882, P77917, Q03EB0, Q02T86, Q9HWC9, A6UZI2, A4VHM4, A4XZ96, C3K2Y2, P0C1T4, P60286, Q6GBU4, P60285, P60284, Q2G0N5, Q5HID2, Q6GJC5, Q2YSB8, Q2FJ97, Q4L3K4, Q8C083, Q5HRK9, Q49V53, Q8DS47, C0M7R5, B8ZNW6, Q04IK7, Q8DNF1, A3CKD4, C1CMQ7, B5E2F2, C1CTL3, C1CGP3, B2IM39, Q97N08, B1I8R3, C1CA05, A8AZI2, A4VSK3, A4VYU4, Q8E238, Q8E7J7, Q3K3L1, C0MEE4, P0C0E0, Q48VR0, A2RC52, Q5XE96, P0DF33, Q1J8X0, Q8P2Y2, Q1JJ22, Q1JNX6, Q1JE19, P0DF32, B9DSZ6, Q5M2F6, Q5LXV4, | O95602 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Staphylococcus epidermidis, Staphylococcus saprophyticus, Streptococcus mutans, Streptococcus equi, Streptococcus pneumoniae, Streptococcus pneumoniae, Streptococcus pneumoniae, Streptococcus sanguinis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus gordonii, Streptococcus suis, Streptococcus suis, Streptococcus agalactiae, Streptococcus agalactiae, Streptococcus agalactiae, Streptococcus equi, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus uberis, Streptococcus thermophilus, Streptococcus thermophilus, Streptococcus thermophilus, Weissella hellenica, Weissella paramesenteroides* | Q03IK3, P96177, P96178 | |
| 183 | AYSGGLDTS | Uncultured termite | B1H0L3 | P00966 |
| 184 | CAAPGGKTTHI | *Haemophilus ducreyi, Haemophilus influenzae* | Q7VKC4, P44788 | Q8TEA1 |
| 185 | CEAHLGHVF | *Acinetobacter baumannii, Acinetobacter baumannii, Acinetobacter baumannii, Acinetobacter baumannii, Acinetobacter baumannii, Acinetobacter baumannii* | B2HYT2, A3M4Q3, B7I415, B0VC45, B7H3X2, B0VR86 | Q9Y3D2 |
| 186 | CEHHLVPFVG | *Streptomyces avermitilis* | Q82EE8 | P30793 |
| 187 | CETDFVSRN | *Desulfovibrio vulgaris, Desulfovibrio vulgaris* | A1VFA9, Q72DQ6 | P43897 |
| 188 | CGNTVVVKP | *Pseudomonas sp., Pseudomonas putida* | P19059, P86808 | P00352 |
| 189 | CGSGVTACH | *Pseudomonas aeruginosa* | Q9I452 | P25325 |
| 190 | CIFEYVYFARPDS | *Haemophilus influenzae* | P43854 | Q06203 |
| 191 | CIGEKLDEREAG | *Desulfovibrio vulgaris, Desulfovibrio vulgaris* | Q72BF9, A1VDB2 | P60174 |
| 192 | CIRAGGKHNDL | *Helicobacter hepaticus* | Q7VHV4 | P49588 |
| 193 | CIRAGGKHNDLD | *Campylobacter fetus, Campylobacter jejuni, Campylobacter jejuni, Campylobacter jejuni, Campylobacter concisus, Campylobacter jejuni, Campylobacter curvus, Campylobacter hominis* | A0RPR0, A8FKT2, Q9PI05, Q5HVQ7, A7ZE62, A7H4N3, A7GZA4, A7I206 | P49588 |
| 194 | CLLTPGHTAG | *Bacillus subtilis* | O34769 | Q6P1I5 |
| 195 | CLNVGCIPSK | *Corynebacterium glutamicum* | Q8NTE1 | P09622 |
| 196 | CLNVGCIPSKALL | *Escherichia coli, Escherichia coli, Escherichia coli, Haemophilus influenzae* | P0A9P1, P0A9P0, P0A9P2, P43784 | P09622 |
| 197 | CLSVNDAFV | *Rhizobium sp., Rhizobium etli* | Q53212, O69777 | P30044 |
| 198 | CNALETLLIH | *Campylobacter jejuni, Campylobacter jejuni, Geobacter lovleyi, Geobacter uraniireducens, Geobacter* | A1VYR7, P53000, B3E3M7, A5G906, Q39QR2, B9M0D6, | P54886 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | metallireducens, Geobacter daltonii, Geobacter sp., Geobacter bemidjiensis | C6E7L9, B5EEI4 | |
| 199 | CNAYTELNDP | Clostridium tetani | Q899G7 | Q15046 |
| 200 | CNRLRITADG | Lactobacillus plantarum, Lactobacillus fermentum | Q88WY1, B2GCN4 | Q9NZB8 |
| 201 | CPVDAIVEG | Clostridium sp. | P00197 | O00217 |
| 202 | CPWGKGRPGWH | Clostridium novyi | A0PXS5 | P49589 |
| 203 | CRMCLVEIE | Rhizobium meliloti | P56914 | P28331 |
| 204 | DADLINAGKET | Bacillus subtilis, Helicobacter pylori, Helicobacter pylori | P42316, P56007, Q9ZLE4 | P55809 |
| 205 | DAFGLPAEN | Clostridium perfringens, Clostridium perfringens, Clostridium perfringens, Clostridium novyi, Clostridium kluyveri, Clostridium botulinum | Q8XML8, Q0SV78, Q0TTD0, A0PYK3, A5N399, A7G9T9 | Q15031 |
| 206 | DAFGTAHRA | Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas hydrophila, Aeromonas salmonicida, Pseudomonas mendocina, Pseudomonas aeruginosa, Pseudomonas aeruginosa, Pseudomonas aeruginosa, Pseudomonas aeruginosa, Pseudomonas fluorescens, Pseudomonas fluorescens, Pseudomonas fluorescens, Pseudomonas entomophila, Pseudomonas putida, Pseudomonas putida, Pseudomonas putida, Pseudomonas putida, Stenotrophomonas maltophilia, Stenotrophomonas maltophilia | B2HZB6, B71501, B0VD03, B7H3N8, B0VMX3, A3M4X6, Q6FB08, A0KGD3, A4SRF1, A4XPG4, B7V4D9, Q9I5Y4, Q02TL3, A6UZ15, C3KF1, Q3K5F2, Q4K4J1, Q113Y0, B1J302, B0KLY7, Q88D64, A5W9Z6, B2FSF3, B4STV2 | P07205 |
| 207 | DAGKTTTTERILYY | Enterococcus faecalis, Streptococcus pyogenes, Streptococcus uberis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus equi, Streptococcus equi, Streptococcus equi, Streptococcus pyogenes | Q839G9, B5XJR1, B9DVS2, P0DA85, Q48VB6, Q1J8I4, Q1JIM6, Q1JNH7, P69948, Q5XDW4, P0DA84, P69946, C0MF25, C0M937, B4U0V9, A2RCI2 | Q969S9 |
| 208 | DAIVNAANS | Ralstonia solanacearum, Staphylococcus aureus, Staphylococcus aureus, Staphylococcus aureus, Staphylococcus aureus, Staphylococcus aureus, Staphylococcus aureus | Q8Y2K1, Q8NYB7, Q6GCE6, Q6GJZ1, P67343, P67344, Q5HIW9 | Q9B069 |
| 209 | DAIVNAANSSLLGGGGVDG | Streptomyces coelicolor | Q9ZBG3 | Q9B069 |
| 210 | DAKINFDDNA | Geobacter sulfurreducens, Staphylococcus haemolyticus, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, | Q74EA5, Q4L5U8, B9DPG0, Q6GHJ0, P66872, Q6G9W8, A8Z355, Q5HGI7, P99071, P66871, A6QGE5, A5ISD0, Q2FZ37, Q2FHJ3, A6U164, A7X1L8, Q2YXM1 | Q96I99 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Staphylococcus aureus, Staphylococcus aureus, Staphylococcus aureus, Staphylococcus aureus | | |
| 211 | DALSSMANI | Haemophilus influenzae | P43842 | Q13423 |
| 212 | DALSSMANIAGY | Escherichia coli | P07001 | Q13423 |
| 213 | DAPVSGGVG | Pseudomonas aeruginosa | P28811 | P31937 |
| 214 | DAQRQATKD | Clostridium cellulolyticum | B8I305 | P11021 |
| 215 | DAQRQATKDAG | ptoclostridium difficile, Corynebacterium kropnstedtii | Q182E8, C4LGV8 | P11021 |
| 216 | DAQRQATKDAGTIAGL | Desulfitobacterium hafniense | B8FUN4 | P11021 |
| 217 | DAVGMSTVPEVIVA | Bacillus subtilis | P46354 | P00491 |
| 218 | DCPGHADYVKNMITG | Helicobacter pylori | Q9ZK19 | P49411 |
| 219 | DDITHPIPDLTG | Geobacter uraniireducens | A5GCR3 | P15313 |
| 220 | DDLLATGGT | Lactobacillus plantarum, Lactobacillus Ocasei, Lactobacillus brevis, Lactobacillus sakei, Lactobacillus salivarius, Bacillus clausii, Bacillus halodurans, Bacillus pumilus, Bacillus cytotoxicus, Bacillus licheniformis, Bacillus subtilis, Bacillus cereus, Bacillus cereus, Bacillus cereus, Bacillus cereus, Bacillus cereus, Bacillus anthracis, Bacillus thuringiensis, Bacillus cereus, Bacillus thuringiensis, Bacillus anthracis, Bacillus anthracis, Bacillus cereus, Bacillus cereus, Clostridium tetani, Desulfovibrio maeticus, Enterococcus faecalis, Haemophilus influenzae, Haemophilus influenzae, Haemophilus influenzae, Haemophilus somnus, Helicobacter pylori, Helicobacter pylori, Helicobacter pylori, Helicobacter pylori, Helicobacter acinonychis, Listeria welshimeri, Listeria monocytogenes, Listeria monocytogenes, Listeria monocytogenes, Listeria innocua, Listeria monocytogenes, Pediococcus ntosaceus | Q88VH0, Q038P1, Q3QP8, Q38W53, Q1WT53, Q5WHQ1, Q9KDH2, A8FFQ0, A7GT90, Q65G08, Q34443, B7HE42, Q634D6, Q817X3, B711S0, Q730C4, Q81LI1, Q6HDB8, B7HQG7, A0RJ16, C3L613, C3P995, B9IYY2, B7JPZ4, Q892A7, C4XU70, Q834G6, A5UBP3, P43856, Q4QJV7, A5UF74, Q0I3U5, O25296, Q1CTV4, B2UTQ6, B6JLF4, B5Z6U3, Q17W08, A0AIX3, C1KVH1, Q71ZE6, B8DHM4, P0A2X6, P0A2X5, Q03F39 | P07741 |
| 221 | DDLLATGGTM | Bacteroides fragilis, Bacteroides fragilis, Geobacter lovleyi, Geobacter uraniireducens, Geobacter daltonii, Geobacter bemidjiensis, Geobacter sp. | Q5LIY6, Q650H6, B3E683, A5G4S5, B9M4Z1, B5EHF2, C6E585 | P07741 |
| 222 | DDNEETIKKRL | Bacteroides thetaiotaomicron, Bacteroides vulgatus, Bacteroides fragilis, Bacteroides fragilis | Q89ZJ0, A6L0Z9, Q64XA6, Q5LGH0 | P00568 |
| 223 | DEELKKAYR | Stenotrophomonas maltophilia | B4SSQ7 | Q9H819 |
| 224 | DEIKKAYRK | Acinetobacter baumannii, Acinetobacter baumannii, Acinetobacter baumannii, Acinetobacter baumannii, Acinetobacter baumannii, Acinetobacter baumannii, Acinetobacter baumannii, Acinetobacter baylyi, Bacillus methylotrophicus, Bacillus pumilus, Bacillus licheniformis, Bacillus subtilis, Lactobacillus plantarum, Lactobacillus brevis, Bifidobacterium longum, Clostridium novyi, Listeria monocytogenes, Listeria innocua, Listeria monocytogenes, Listeria monocytogenes, Listeria monocytogenes, Listeria | B0VA24, A3MA88, B0VQ00, B212G6, B7I2B2, B7GV08, Q6F6R1, A7Z6W0, A8FFD1, Q65H55, P17631, Q88VM1, Q03QU2, Q8G6C6, A0Q1R3, B8DE39, Q92BN9, P0DJM1, G2K045, Q71ZJ8, C1KVB9, A0AIS3, A1KR91, P63969, P63968, A9LZV9, Q5F5M1, Q8XW41, B2UBP2, Q2YT48, P63972, A8Z4B8, | O75953 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | monocytogenes, Listeria welshimeri, Neisseria meningitidis, Neisseria meningitidis, Neisseria meningitidis, Neisseria gonorrhoeae, Ralstonia solanacearum, Ralstonia pickettii, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Streptococcus pneumoniae, Streptococcus pneumoniae | Q6G8Y8, P63971, P63970, A6QHC2, Q5HFI1, A5ITA7, Q2FXZ3, Q2FGE4, A6U251, A7X2Y0, Q6GGC1, P45555, Q8CVVT2, P95830 | |
| 225 | DEIKKAYRKM | Streptococcus uberis | B9DVF2 | O75953 |
| 226 | DELGRGTAT | Leuconostoc citreum, Leuconostoc mesenteroides | B1N025, Q03VV4 | P52701 |
| 227 | DELGRGTSTYDG | Bacteroides fragilis, Bacteroides fragilis, Bacteroides thetaiotaomicron, Bacteroides vulgatus, Porphyromonas gingivalis | Q64MG7, Q5L7B7, Q8A334, A6KZM1, Q7MXR7 | P43246 |
| 228 | DEPTNHLDME | Escherichia coli, Escherichia coli, Escherichia coli | P0A9U3, P0A9U4, P0A9U5 | Q9NUQ8 |
| 229 | DEVQTGFGR | Bacillus pseudofirmus | P30268 | Q9BYV1 |
| 230 | DEYVGLPRDH | Corynebacterium kropnstedtii | C4LL80 | P46926 |
| 231 | DFALWKAAKP | Corynebacterium glutamicum, Corynebacterium diphtheriae, Corynebacterium glutamicum, Desulfovibrio salexigens | A4QH41, Q6NFC3, Q8NMD7, C6B523 | Q9HA77 |
| 232 | DFALWKASKP | Fusobacterium nucleatum | Q8RIK9 | P49589 |
| 233 | DFALWKASKPGEP | Desulfovibrio maeticus | C4XSW5 | P49589 |
| 234 | DFIKTSTGK | Aeromonas salmonicida, Aeromonas hydrophila, Edwardsiella ictaluri, Enterobacter sp., Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus parasuis, Haemophilus ducreyi, Klebsiella pneumoniae, Proteus mirabilis | A4SRU4, A0KPE4, C5BHJ2, A4W698, B1LEI6, B7LXU3, B7LNS1, B6I6M8, B1IS38, A8A8B0, B7NW61, B7N2V7, B5Z4R3, Q8XB36, B7LEM7, A7ZVS4, B7UR09, P0A6L0, B7NH49, P0A6L1, B1XFJ1, B7MNI8, Q0T8T2, C4ZT63, A1AJU8, B8F671, Q7VMS9, B5Y277, B4EWA4 | Q9Y315 |
| 235 | DFSGGWRMR | Escherichia coli, Escherichia coli | P63390, P63389 | Q9UG63 |
| 236 | DFSSPNIAK | Fusobacterium nucleatum | Q8RG14 | P54136 |
| 237 | DFTFVCPTE | Bacillus sp., Escherichia coli, Escherichia coli, Escherichia coli | P26830, P0AE08, P0AE09, P0AE10 | Q06830 |
| 238 | DFTFVCPTEI | Bacillus subtilis | Q34564 | Q06830 |
| 239 | DFTFVCPTEIIAF | Helicobacter pylori, Helicobacter pylori | P56876, P21762 | Q06830 |
| 240 | DGAGKTSVL | Streptococcus uberis | B9DTV7 | Q6T311 |
| 241 | DGEAGGITQ | Lactobacillus brevis | Q03QT5 | Q60841 |
| 242 | DGGQWDMLV | Listeria monocytogenes, Listeria innocua | Q69192, Q928V0 | Q13867 |
| 243 | DGHIAFNEP | Corynebacterium diphtheriae | Q6NJ91 | P46926 |
| 244 | DGHTASLFP | Haemophilus influenzae, Helicobacter pylori, Helicobacter pylori, | Q57039, O25730, Q9ZKB1, Q9EV79, | Q95479 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Pseudomonas putida, Pseudomonas aeruginosa* | Q9X2N2 | |
| 245 | DGILVPGGFG | *Desulfovibrio desulfuricans* | B8IZF5 | Q9NRF8 |
| 246 | DGKLYGRGA | *Ralstonia solanacearum* | Q8XZK5 | Q96KN2 |
| 247 | DGLGFGDNTKAA | *Desulfitobacterium hafniense* | Q24VA4 | P21695 |
| 248 | DGPLDMRMD | *Acinetobacter baumannii, Acinetobacter baumannii, Acinetobacter baumannii, Acinetobacter baumannii, Acinetobacter baumannii, Acinetobacter baumannii, Acinetobacter baylyi, Citrobacter koseri, Desulfovibrio alaskensis, Desulfovibrio vulgaris, Desulfovibrio vulgaris, Desulfovibrio vulgaris, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter lovleyi, Haemophilus ducreyi, Haemophilus parasuis, Klebsiella pneumoniae, Klebsiella pneumoniae, Proteus mirabilis, Pseudomonas syringae, Pseudomonas fluorescens, Pseudomonas syringae, Pseudomonas fluorescens, Pseudomonas savastanoi, Pseudomonas fluorescens, Pseudomonas stutzeri, Ralstonia solanacearum, Ralstonia pickettii, Ralstonia pickettii* | B0VPF9, B0V8N7, A3M9K5, B2I0K7, B7GVN1, B7IAX1, Q6F7D1, A8ALL4, Q313R1, B8DP86, A1VBE0, P62470, C5B9E8, A4W6I5, B7LWH0, B1LG19, Q1RGB3, B6HZ59, A7ZW34, B7N7V5, P60390, A1A7C7, B1IR96, Q0TLQ7, C5W331, B1XC59, C6UM45, C4ZQ04, B7M125, B5YZB8, P60391, B7LFV2, B7MAK5, A7ZHH3, B7NHI8, Q8FL68, B7MNU1, B7UID2, B3E3Z0, Q7VP62, B8F3A8, A6T4M5, B5Y1V5, B4F119, Q87WX7, C3KCS2, Q4ZNY2, Q3K736, Q48EF0, Q4K6I5, A4VIH0, Q8XVH9, C6BEJ1, B2UCY5 | A6NJ78 |
| 249 | DGPMPQTREH | *Lactobacillus brevis, Desulfovibrio vulgaris, Desulfovibrio vulgaris, Desulfovibrio vulgaris, Desulfovibrio desulfuricans, Desulfovibrio alaskensis* | Q03QN5, B8DLL9, A1VAK4, Q727D5, B8J1A0, Q30X13 | P49411 |
| 250 | DGTKFDSSLDR | *Neisseria meningitidis* | P0A0W3 | Q02790 |
| 251 | DGVGTKLKIA | *Rhizobium leguminosarum* | Q9XAT2 | P22102 |
| 252 | DGWDSEPFT | *Campylobacter concisus* | A7ZFC1 | Q96KP4 |
| 253 | DHGKSTLADR | *Acinetobacter baumannii, Acinetobacter baumannii, Acinetobacter baumannii, Acinetobacter baumannii, Acinetobacter baumannii, Acinetobacter baumannii, Acinetobacter baylyi, Bacillus cytotoxicus, Bacillus halodurans, Bacillus clausii, Bacillus subtilis, Bacillus pumilus, Bacillus cereus, Bacillus methylotrophicus, Bacillus licheniformis, Bacillus cereus, Bacillus cereus, Bacillus anthracis, Bacillus cereus, Bacillus cereus, Bacillus anthracis, Bacillus anthracis, Bacillus thuringiensis, Bacillus cereus, Bacillus cereus, Bacillus thuringiensis, Bacillus cereus, Bacillus cereus, Bacillus weihenstephanensis, Lactobacillus sakei, Lactobacillus casei, Lactobacillus casei, Eubacterium rectale, Eubacterium eligens, Propionibacterium acnes,* | B0VCT7, A3M7P5, B2HWQ2, B71580, B7GYS7, B0VTM2, Q6F9B9, A7GT14, Q9KD76, Q5WHG5, P37949, A8FFD6, Q730L6, A7Z6W5, Q65H50, B7HCU5, B7IYH2, C3L5S2, B7HPL8, B7JNV1, Q81LR7, C3P8M5, Q6HDK2, Q634M2, C1ESL3, A0RIT7, Q818E4, B9IY86, A9VHU6, Q38W39, Q038N6, B3WEQ5, C4Z9E3, C4Z541, Q6A9B2, A0RQX4, A1W018, Q9PNR1, A8FM79, Q5HU70, A7H311, B9KD01, A9KKU4, Q72E76, B8DIZ5, C6BST2, | Q8N442 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Campylobacter fetus, Campylobacter jejuni, Campylobacter jejuni, Campylobacter jejuni, Campylobacter jejuni, Campylobacter lari, Clostridium phytofermentans, Desulfovibrio vulgaris, Desulfovibrio vulgaris, Desulfovibrio salexigens, Desulfovibrio alaskensis, Desulfovibrio desulfuricans, Enterococcus faecalis, Kocuria rhizophila, Listeria monocytogenes, Listeria monocytogenes, Listeria monocytogenes, Listeria monocytogenes, Listeria innocua, Listeria welshimeri, Micrococcus luteus, Neisseria gonorrhoeae, Neisseria gonorrhoeae, Neisseria meningitidis, Neisseria meningitidis, Neisseria meningitidis, Neisseria meningitidis, Pseudomonas mendocina, Pseudomonas syringae, Pseudomonas entomophila, Pseudomonas fluorescens, Pseudomonas fluorescens, Pseudomonas putida, Pseudomonas putida, Pseudomonas putida, Pseudomonas savastanoi, Pseudomonas syringae, Pseudomonas putida, Pseudomonas fluorescens, Pseudomonas stutzeri, Pseudomonas aeruginosa, Pseudomonas aeruginosa, Pseudomonas aeruginosa, Pseudomonas aeruginosa, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus epidermidis, Staphylococcus epidermidis, Staphylococcus carnosus, Staphylococcus saprophyticus, Streptococcus pneumoniae, Streptococcus pneumoniae, Streptococcus pneumoniae, Streptococcus pneumoniae, Streptococcus pneumoniae, Streptococcus suis, Streptococcus suis, Streptococcus mutans, Streptococcus gordonii, Streptococcus pneumoniae, Streptococcus pneumoniae, Streptococcus pneumoniae, Streptococcus pneumoniae, Streptococcus uberis, Streptococcus thermophilus, Streptococcus thermophilus, Streptococcus thermophilus, Streptococcus equi, Streptococcus equi, Streptococcus pneumoniae, Streptococcus | Q30XI4, B8J444, Q831Z0, B2GHU9, Q8Y742, B8DE32, C1KVC6, Q71ZJ1, Q92BN4, A0AIS8, C5CCD4, Q5F9P9, B4RK41, A1KT27, Q9K055, Q9JV65, A9M3J8, A4XSC1, Q87XF8, Q1I5V6, C3K6G8, Q4KHT3, A5W8F4, Q88MY7, B0KV29, Q48EV0, Q4ZPD8, B1J4D8, Q3KHM1, A4VIX2, Q9I5G8, Q02HR9, B7UYX5, A6VAK9, A8Z4C4, A6QHC7, Q5HFH6, Q2FXY7, Q2FGD9, Q6G8Y3, Q6GGB6, P65272, P65271, A5ITB2, Q2YT42, A7X2Y7, A6U257, Q8NWA7, Q4L6T4, Q5HNW2, Q8CP13, B9DNK4, Q49Y26, C1CKU6, Q970K5, C1C7G9, B5E4T8, B1ICO2, A4VUL8, A4WOW0, Q8DTF3, A8AWG3, C1CR98, Q8DPN5, B8Z069, Q04KB7, B9DSE0, Q5M008, Q03KW7, Q5M4M2, B4U3G9, C0M8H9, C1CEG3, P65274, Q3K1F9, P65273, C0MDV7, Q1JH37, Q48TU0, Q1JLY8, Q99ZV8, B5XLC6, P0DC23, P0DC22, Q1JC06, Q5XCD2, Q1J6V6, Q82BZ3, Q9RDC9, B1VY28 | |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | agalactiae, Streptococcus agalactiae, Streptococcus agalactiae, Streptococcus equi, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptomyces avermitilis, Streptomyces coelicolor, Streptomyces griseus | | |
| 254 | DHGKSTLADRL | Desulfitobacterium hafniense, Desulfitobacterium hafniense, Campylobacter hominis, Campylobacter concisus, Campylobacter curvus, ptoclostridium difficile, Finegoldia magna, Helicobacter hepaticus, Sphingomonas wittichii | Q245R6, B8FUP2, A7I1F0, A7ZCJ3, A7GZW3, Q182F4, B0S1G2, Q7VJZ1, A5VB59 | Q8N442 |
| 255 | DHGKSTLADRLLE | Bacteroides vulgatus, Parabacteroides distasonis, Bacteroides thetaiotaomicron, Bacteroides fragilis, Bacteroides fragilis, Clostridium acetobutylicum, Clostridium novyi, Clostridium cellulolyticum, Clostridium thermocellum, Clostridium tetani, Geobacter metallireducens, Geobacter bemidjiensis, Geobacter uraniireducens, Geobacter sulfurreducens, Geobacter sp., Geobacter daltonii, Geobacter lovleyi, Porphyromonas gingivalis, Porphyromonas gingivalis | A6L744, A6LC18, Q8AA33, Q64T74, Q5LC85, Q97JJ6, A0Q1R8, B8I3E6, A3DF29, Q892Q6, Q39U57, B5EB36, A5G4G3, P60789, C6DZ67, B9M4U5, B3E9R0, B2RKK1, Q7MV56 | Q8N442 |
| 256 | DHPDAFDNEL | Clostridium botulinum, Clostridium botulinum, Clostridium botulinum, Clostridium botulinum, Clostridium botulinum | A7GGE1, B1IJ68, C1FSX6, C3L140, B1KXA7 | Q9BZX2 |
| 257 | DHYENPRNVGS | Escherichia coli, Escherichia coli, Escherichia coli | P0ACD5, P0ACD4, P0ACD6 | Q9H1K1 |
| 258 | DHYENPRNVGSLDK | Haemophilus influenzae | Q57074 | Q9H1K1 |
| 259 | DIEMSFVDQ | Corynebacterium diphtheriae, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus epidermidis, Staphylococcus epidermidis | Q6NGZ4, Q49Y68, Q2FXU5, P67016, A8Z2F7, Q6G8T9, P67015, A6QHH2, P67014, Q5HFD3, A5ITF4, Q2YT75, Q2FG97, A7X344, A6U298, Q6GG73, Q4L6X5, Q8C599, Q5HN52 | Q6PI48 |
| 260 | DILVNNAGI | Bacillus subtilis, Bacillus subtilis, Haemophilus influenzae | P42317, P50842, P43713 | Q6IAN0 |
| 261 | DILVNNAGV | Rhizobium meliloti | O86034 | P15428 |
| 262 | DISPQAPTH | Escherichia coli, Escherichia coli | P0ACE7, P0ACE8 | P49773 |
| 263 | DIYSRLLRERI | Methylobacterium populi, Methylobacterium extorquens, Methylobacterium extorquens, | B1Z9C7, A9W5F5, B7KNT0, B1LW28, B8IN26, Q1MK43, | Q16740 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Methylobacterium radiotolerans, Methylobacterium nodulans, Rhizobium leguminosarum, Rhizobium meliloti, Rhizobium etli | P58277, Q2KAB9 | |
| 264 | DKAGGYGIQ | Parabacteroides distasonis, Pseudomonas fluorescens | A6L8E5, Q3KI22 | O95671 |
| 265 | DKHSTGGVGD | Rhizobium loti | Q98GV5 | P19971 |
| 266 | DKPDTRFGM | Eubacterium rectale | C4ZI12 | Q6PI48 |
| 267 | DKPRYLMGVG | Acinetobacter baumannii, Aeromonas hydrophila, Aeromonas salmonicida, Lactobacillus sakei, Bacillus clausii, Citrobacter koseri, Desulfovibrio vulgaris, Desulfovibrio vulgaris, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Haemophilus influenzae, Haemophilus influenzae, Haemophilus somnus, Haemophilus parasuis, Haemophilus ducreyi, Klebsiella pneumoniae, Klebsiella pneumoniae, Proteus mirabilis, Pseudomonas putida, Pseudomonas aeruginosa, Pseudomonas aeruginosa, Pseudomonas aeruginosa, Pseudomonas syringae, Rhizobium meliloti, Rhizobium loti, Staphylococcus haemolyticus | B0VRA8, A0KJ20, A45P26, Q38YP9, Q5WHR2, A8AK48, A1VFP3, Q72E53, C5BCF7, A4W779, B7LMI1, B7N8V8, B1J043, Q1RFD5, B1LJF4, B6HZK6, B7M3P5, P0A847, P0A848, B7L639, Q0TKN5, A7ZX57, A1A876, C4ZTG3, B7MD64, B1XEZ4, B5Z2W2, B7MPG7, B7NJ96, P0A849, A7ZIF8, B7UJM9, Q4QNU3, A5UG47, A5UAP3, P44594, Q0I4R8, B8F3W0, Q7VLQ4, A6T5D8, B5Y0Y6, B4EU13, Q88PL7, Q9HXH9, B7UVU4, Q02RX7, Q887B0, Q92PY4, Q98M57, Q4L6Y4 | Q9BXR0 |
| 268 | DKTGTITHG | Ralstonia solanacearum | Q8XU11 | P35670 |
| 269 | DLAIDGADEVD | Staphylococcus haemolyticus | Q4L8J6 | P49247 |
| 270 | DLEFVQFHPT | Rhizobium loti, Streptomyces coelicolor | Q98AV8, Q9X8N8 | P31040 |
| 271 | DLIIPRGSS | Bacteroides fragilis, Bacteroides fragilis, Bacteroides thetaiotaomicron, Parabacteroides distasonis | Q64Z29, Q5LI24, Q8A1E8, A6LE74 | P54886 |
| 272 | DLIVSNPPY | Aeromonas hydrophila, Aeromonas salmonicida, Fusobacterium nucleatum, Clostridium botulinum, Enterobacter sp., Geobacter sulfurreducens, Haemophilus influenzae, Haemophilus parasuis, Proteus mirabilis | A0KPC4, A4SRS5, Q8R619, A5HY34, A4WDE6, Q74862, P45253, B8F678, B4F055 | Q9Y5R4 |
| 273 | DLIVSNPPYV | Neisseria meningitidis, Neisseria meningitidis, Neisseria gonorrhoeae, Pseudomonas aeruginosa | Q9JTA1, Q9JYC0, Q5F783, Q91347 | Q9Y5R4 |
| 274 | DLKKAYRRLA | Pseudomonas fluorescens, Pseudomonas entomophila | C3K274, Q1IF58 | Q9NXW2 |
| 275 | DLNRAGVGL | Uncultured termite | B1GZD2 | O75879 |
| 276 | DLPLNVSRE | Arcobacter butzleri, Methylobacterium sp., Geobacter uraniireducens, Helicobacter acinonychis, Helicobacter pylori, Helicobacter pylori, Helicobacter hepaticus, Methylobacterium nodulans, Methylobacterium radiotolerans, Rhizobium etli, Rhizobium meliloti | A8EV23, B0UN89, A5GER7, Q17VU7, Q1CUU4, Q9ZMM2, Q7VFD7, B81U50, B1LZG0, Q2JZH2, P58477 | P14625 |
| 277 | DLQEDKEAVF | Bifidobacterium longum, Bifidobacterium longum, Bifidobacterium longum | B7GTN9, Q8G5F3, B3DSY6 | P04424 |
| 278 | DLRLNEPRYA | Pseudomonas aeruginosa | Q9HZP6 | P38117 |
| 279 | DLTDEEKQE | Bacillus licheniformis | Q65KJ6 | Q969G3 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 280 | DLTHNPEFT | *Campylobacter hominis* | A7I358 | Q15046 |
| 281 | DLTHNPEFTT | *Campylobacter jejuni, Campylobacter jejuni, Campylobacter jejuni, Campylobacter jejuni, Campylobacter jejuni* | A8FKI8, A7H4X7, Q5HW66, A1VYC1, P41258 | Q15046 |
| 282 | DLTVPFARY | *Propionibacterium acnes, Micrococcus luteus* | Q6A8J7, C5CCH4 | P12081 |
| 283 | DLVGNNTPIFF | *Micrococcus luteus* | P29422 | P04040 |
| 284 | DLVGNNTPIFFI | *Escherichia coli* | P21179 | P04040 |
| 285 | DNFWEMGDTGPCGPCSEIH | *Bacteroides fragilis, Bacteroides fragilis, Bacteroides thetaiotaomicron, Parabacteroides distasonis, Bacteroides vulgatus, Porphyromonas gingivalis* | Q64Y64, Q5LHE6, Q8A0M6, A6LEZ8, A6L1L8, Q7MV54 | P49588 |
| 286 | DNHLILVDL | *Clostridium perfringens, Clostridium perfringens, Clostridium botulinum, Clostridium perfringens, Clostridium botulinum* | Q8XJ32, Q0TP32, B2V398, Q0SRQ2, B2TN52 | P34896 |
| 287 | DNHLILVDLRS | *Bacillus subtilis* | P39148 | P34896 |
| 288 | DPLDGSSNI | *Methylobacterium radiotolerans, Methylobacterium populi, Methylobacterium extorquens, Methylobacterium extorquens* | B1LUU9, B1Z939, B7L270, A9W1C8 | P09467 |
| 289 | DPLDGSSNID | *Aeromonas hydrophila, Aeromonas salmonicida, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Haemophilus ducreyi, Haemophilus influenzae, Haemophilus somnus, Klebsiella pneumoniae, Klebsiella pneumoniae, Proteus mirabilis, Rhizobium meliloti* | A0KJT2, A4SM33, A8AMG4, A4W5X6, Q1R324, B1LRB5, P0A994, P0A993, B1ISX3, Q0T9F7, A1AJD7, A8A7Y7, B1XEL4, A7ZVB0, B5Z317, Q8XCF0, A5UCP1, P45292, Q7VN74, Q4QL80, Q0I4Y5, B5Y2X3, A6THE3, B4F298, Q9EXV4 | P09467 |
| 290 | DPSIFTVLT | *Pseudomonas syringae* | Q4ZR64 | Q93099 |
| 291 | DPTLLFANAGMNQFK | *Geobacter metallireducens, Geobacter sulfurreducens* | Q39Z77, P61701 | P49588 |
| 292 | DQISDAVLD | *Desulfovibrio alaskensis, Haemophilus ducreyi, Haemophilus influenzae, Haemophilus influenzae, Haemophilus influenzae, Haemophilus influenzae, Haemophilus somnus, Haemophilus parasuis, Helicobacter hepaticus, Helicobacter pylori, Helicobacter pylori, Helicobacter pylori, Helicobacter pylori, Helicobacter pylori, Helicobacter pylori, Helicobacter acinonychis* | Q311V1, Q7VNG7, A5UIU0, A5UCT6, P43762, Q4QLC5, Q0I559, B8F4B2, Q7VFY5, Q9ZMN5, B6JPU7, B5Z9W8, Q1CUW4, B2US27, P56460, Q17YQ7 | P31153 |
| 293 | DQISDAVLDA | *Citrobacter koseri, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis, Pseudomonas mendocina, Pseudomonas savastanoi, Pseudomonas syringae, Pseudomonas syringae, Pseudomonas stutzeri, Pseudomonas fluorescens, Pseudomonas putida,* | A8APG1, C5BAV4, A4WE78, B7LPQ9, B1LDF1, B61780, B7N7J5, P0A817, B1IT65, P0A818, A8A481, Q0TDR0, B1XFA4, C5A0L1, B5YQD9, B7NI05, B7LYX2, P0A819, B7LFK4, B7UHY9, A7ZR64, A6TDV1, B5XUA8, B4F1A5, A4XPF8, Q48CH3, Q4ZMO1, Q88AK7, A4VRE8, C3K3F5, B1J2Z8, Q4K4I7, Q3K5E8, A6UZ09, Q915Z0, Q02TL9, B7V4D3, Q88D60, | Q00266 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Pseudomonas fluorescens, Pseudomonas fluorescens, Pseudomonas aeruginosa, Pseudomonas aeruginosa, Pseudomonas aeruginosa, Pseudomonas aeruginosa, Pseudomonas putida, Pseudomonas putida, Pseudomonas putida, Pseudomonas entomophila, Stenotrophomonas maltophilia, Stenotrophomonas maltophilia* | B0KLZ1, A5WA00, Q1I3X6, B2FPC7, B4SK03 | |
| 294 | DRILASRMG | *Clostridium tetani* | Q890Z2 | Q01813 |
| 295 | DRQPEFTQID | *Lactobacillus casei, Lactobacillus casei, Lactobacillus plantarum, Lactobacillus sakei, Lactobacillus johnsonii, Lactobacillus acidophilus, Lactobacillus reuteri, Lactobacillus reuteri, Lactobacillus fermentum, Bacteroides fragilis, Bacteroides fragilis, Parabacteroides distasonis, Campylobacter jejuni, Campylobacter jejuni, Campylobacter jejuni, Citrobacter koseri, Clostridium phytofermentans, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Geobacter sp., Geobacter bemidjiensis, Geobacter uraniireducens, Geobacter sulfurreducens, Geobacter daltonii, Geobacter metallireducens, Haemophilus ducreyi, Haemophilus parasuis, Haemophilus influenzae, Haemophilus influenzae, Klebsiella pneumoniae, Klebsiella pneumoniae, Listeria monocytogenes, Listeria monocytogenes, Listeria monocytogenes, Listeria innocua, Listeria welshimeri, Neisseria meningitidis, Neisseria gonorrhoeae, Neisseria meningitidis, Neisseria meningitidis, Neisseria meningitidis, Pediococcus ntosaceus, Proteus mirabilis* | Q038S1, B3WEM2, Q88V08, Q38X136, Q74IX4, Q5FKI4, B2G6X9, A5VJG4, B2GBY7, Q64T01, Q5LCK2, A6LBU6, Q9PHM7, A8FL61, A1VZ00, A8AFH5, A9KIA6, A4WBM3, Q8XCI7, B5YR11, P21889, A8A166, C4ZQF0, B1XHD4, B7NS52, B6IBU5, B1LD05, B7NBL7, B1J0M2, B7M2F7, B7L7R9, A7ZMZ0, B7LPH8, B7USP3, Q1RAR8, Q8FGQ9, Q0TGW6, A1AC27, B7MVZ7, B7MBS5, C6E3W7, B5EIV1, A5G3L5, Q74D56, B9M1C9, Q39VY3, Q7VNF0, B8F789, A5UAG7, A5UGD3, A6TB35, B5XQ00, B8DHM9, Q71ZF1, C1KVG6, Q8Y709, Q92BJ4, A0AIW8, A9M257, B4RPA1, A1KVG2, Q9JT23, Q9K0U5, Q03F52, B4ETP3 | Q6PI48 |
| 296 | DRQPEFTQIDIE | *Bacillus clausii, Bacillus haloduans, Enterococcus faecalis, Pseudomonas fluorescens, Pseudomonas syringae, Pseudomonas syringae, Pseudomonas savastanoi, Pseudomonas fluorescens* | Q5WHP3, Q9KDG1, Q833I2, Q3K7V6, Q4ZWL5, Q87Y31, Q48FC1, C3JYT1 | Q6PI48 |
| 297 | DRQPEFTQIDIEMSF | *Bacillus subtilis, Bacillus methylotrophicus, Bacillus licheniformis, Campylobacter jejuni, Helicobacter hepaticus* | O32038, A7Z750, Q65GR4, Q5HVD1, Q7VF76 | Q6PI48 |
| 298 | DRQPEFTQIDIEMSFV | *Clostridium cellulolyticum* | B8I3F1 | Q6PI48 |
| 299 | DRTGTGTLS | *Citrobacter koseri, Corynebacterium aurimucosum, Edwardsiella ictaluri, Enterobacter sp., Escherichia coli, Escherichia coli, Escherichia coli, Escherichia coli, Escherichia coli, Escherichia coli, Escherichia coli,* | A8AP42, C3PEY5, C5BH86, A4WE03, A8A3W0, B1IU17, P0A884, B7N759, P0A885, B7LY83, B7NVX2, C4ZZX9, | P04818 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii | B7MZC6, Q1R7I6, P0A886, Q0TE05, B7LF04, A1AF39, B7UHP4, B7MLH3, A7ZQT3, B7LNI2 | |
| 300 | DRTGTGTLSVFG | Methylobacterium extorquens, Methylobacterium nodulans, Neisseria gonorrhoeae | B7KQG2, B8IF20, O33380 | P04818 |
| 301 | DSGGARIQEG | Propionibacterium freudenreichii | Q8GBW6 | P05166 |
| 302 | DSKPGTIRGD | Clostridium thermocellum | A3DDC2 | O60361 |
| 303 | DSRGNPTVE | Aeromonas salmonicida, Aeromonas hydrophila, Aeromonas hydrophila, Lactobacillus johnsonii, Lactobacillus gasseri, Corynebacterium aurimucosum, Corynebacterium diphtheriae, Corynebacterium glutamicum, Corynebacterium glutamicum, Corynebacterium efficiens, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus somnus, Haemophilus parasuis, Haemophilus ducreyi, Haemophilus influenzae, Haemophilus influenzae, Haemophilus influenzae, Haemophilus influenzae, Klebsiella pneumoniae, Klebsiella pneumoniae, Neisseria meningitidis, Neisseria gonorrhoeae, Neisseria gonorrhoeae, Neisseria meningitidis, Neisseria meningitidis, Neisseria meningitidis, Proteus mirabilis, Pseudomonas aeruginosa, Pseudomonas aeruginosa, Pseudomonas aeruginosa, Pseudomonas aeruginosa, Pseudomonas mendocina, Pseudomonas savastanoi, Pseudomonas syringae, Pseudomonas syringae, Pseudomonas fluorescens, Pseudomonas fluorescens, Pseudomonas putida, Pseudomonas putida, Pseudomonas putida, Pseudomonas entomophila, Ralstonia pickettii, Ralstonia solanacearum | A4SRC1, A0KGH3, Q8GE63, Q74K78, Q042F4, C3PFA7, Q6NI61, Q8NRS1, A4QCV0, Q8FQS7, C5B8X2, A4WDW7, B7LWP5, Q1R7R4, B1LQB2, B6I6H5, B7N715, P0A6P9, B7MZ75, B1IU62, P0A600, Q0TE80, A7ZQM2, A1AEW7, A8A3R4, B1XDI9, C4ZZT2, B7LXJ5, B7NV69, B5Z3E3, P0A6Q1, B7LEJ8, B7MLA0, B7UHJ5, Q011Z1, B8F8L5, Q7VNM6, A5UDD6, P43806, Q4QLX6, A5UI73, B5XV19, A6TD53, A9LZL4, B4RMD8, Q5F8Z2, Q9JU46, Q9JZ53, A1KUB6, B4EUF7, A6V1F3, Q9HXZ5, B7V7V4, Q02RA7, A4XWS1, Q48F79, Q4ZWQ8, Q886M3, Q3KH92, Q4KHF6, B1JB38, Q88MF9, B0KSB9, Q1I646, B2U9C3, Q8Y0B5 | P06733 |
| 304 | DSRGNPTVEV | Bacillus cytotoxicus, Bacillus thuringiensis, Bacillus anthracis, Bacillus cereus, Bacillus thuringiensis, Bacillus anthracis, Bacillus cereus, Bacillus anthracis, Bacillus cereus, Bacillus weihenstephanensis, Lactobacillus casei, Bacillus licheniformis, Lactobacillus casei, Lactobacillus plantarum, Bacillus methylotrophicus, Bacillus subtilis, Bacillus pumilus, Bacillus cereus, Bacillus cereus, Bacillus cereus, Bacillus cereus, Bacillus cereus, Bacillus cereus, Lactobacillus brevis, Bacillus clausii, Bacillus halodurans, | A7GUR7, Q6HBF3, C3P0A3, C1EZA0, A0RKS3, Q81X78, B7JFG3, C3LDI0, Q631M2, A9VQ48, Q03AK4, Q65EN2, B3WCVV7, Q88YH3, A7Z8Y1, P37869, A8FHJ0, B7HW52, B9J4M4, Q72XY5, B7HED2, Q815K8, B7IP20, Q03SL5, Q5WDK9, Q9K717, Q24MW5, B7GTK2, A1A143, A0PYP4, | P06733 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
|  |  | Desulfitobacterium hafniense, Bifidobacterium longum, Bifidobacterium adolescentis, Clostridium novyi, ptoclostridium difficile, Clostridium thermocellum, Clostridium cellulolyticum, Corynebacterium kropnstedtii, Corynebacterium urealyticum, Desulfovibrio desulfuricans, Desulfovibrio salexigens, Desulfovibrio alaskensis, Desulfovibrio maeticus, Desulfovibrio vulgaris, Finegoldia magna, Kocuria rhizophila, Listeria welshimeri, Listeria monocytogenes, Listeria innocua, Listeria monocytogenes, Listeria monocytogenes, Listeria monocytogenes, Micrococcus luteus, Pediococcus ntosaceus, Propionibacterium acnes, Staphylococcus epidermidis, Staphylococcus epidermidis, Staphylococcus haemolyticus, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Streptomyces coelicolor, Streptomyces avermitilis | Q181T5, A3DBQ5, B8I4U1, C4LHL7, B1VFL0, B8J467, C6BSL8, Q316Q0, C4XLR9, O32513, B0S1G7, B2GM13, A0ALD9, P64074, P64075, Q71WX1, B8DDA1, C1KY94, C5C987, Q03GW5, Q6AAB8, Q8CPY3, Q5HQV0, Q4L4K7, B9DJJ9, O69174, Q6GIL4, A8Z1A4, A6QF85, P64079, P64078, Q6GB54, Q2YSE8, P99088, Q5HHP1, Q2G028, A5I0Y0, A7WZT2, Q2FIL7, A6TZQ5, Q49W03, Q9F2Q3, Q82HH5 |  |
| 305 | DSRGNPTVEVD | Fusobacterium nucleatum, Bacteroides vulgatus, Bacteroides fragilis, Bacteroides fragilis, Bacteroides thetaiotaomicron, Corynebacterium jeikeium, Methylobacterium extorquens, Methylobacterium extorquens, Methylobacterium populi, Methylobacterium radiotolerans, Sphingomonas wittichii, Uncultured termite | Q8RI55, A6L3M9, Q8KNX9, Q5LG64, Q89Z05, Q4JU51, B7KRB4, A9W6G9, B1ZEJ8, B1LZU6, A5V3E8, B1GYL7 | P06733 |
| 306 | DTCQGDSGGP | Streptomyces exfoliatus, Streptomyces griseus | P80420, P00775 | P10323 |
| 307 | DTGMGLERL | Clostridium phytofermentans, Uncultured termite | A9KMW7, B1GZ43 | Q5JTZ9 |
| 308 | DTRGIFRVH | Propionibacterium acnes | Q6A5P0 | P49591 |
| 309 | DTRGIFRVHQF | Streptomyces avermitilis, Streptomyces coelicolor, Streptomyces griseus | Q82FK8, Q9ZBX1, B1VP80 | P49591 |
| 310 | DVANAVLDG | Lactobacillus delbrueckii, Escherichia coli | P34038, P21599 | P30613 |
| 311 | DVAVIGVPD | Proteus mirabilis, Proteus sp. | B4EY25, Q8GB18 | Q4G176 |
| 312 | DVFCEKGVF | Parabacteroides distasonis | A6LI30 | Q96NU7 |
| 313 | DVGCGSGIL | Clostridium beijerinckii | A6LRN8 | Q86X55 |
| 314 | DVGCGTGILS | Clostridium thermocellum | A3DF23 | O60678 |
| 315 | DVINAAEKL | Escherichia coli, Escherichia coli, Escherichia coli | P0A9T2, P0A9T0, P0A9T1 | Q43175 |
| 316 | DVKVVILGQDPYH | Lactobacillus casei, Lactobacillus casei | B3WCZ5, Q03AI1 | P13051 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 317 | DVKVVILGQDPYHG | Campylobacter concisus, Haemophilus influenzae, Haemophilus influenzae | A7ZAZ4, Q4QPM6, A5UBC0 | P13051 |
| 318 | DVKVVILGQDPYHGP | Bacillus subtilis, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Streptococcus sanguinis, Streptococcus gordonii | P39615, B7LUY5, B7MYL3, Q1R8F2, B1LP93, A1AEB0, B7MIR5, B7UH19, A7ZQ25, Q0TEQ8, B7NRN6, B7N6H1, Q8X444, B5Z154, B615F5, P12295, B1IVP7, B1XBQ7, A8A392, C4ZYK3, B7M8J5, B7LDH3, Q8FF08, A6TCJ2, B5XNF8, A3CN85, A8AXM4 | P13051 |
| 319 | DVKVVILGQDPYHGPNQAHGL | Desulfitobacterium hafniense, Desulfitobacterium hafniense, Clostridium botulinum, Clostridium botulinum, Haemophilus influenzae, Staphylococcus haemolyticus | Q24YA3, B8FSV8, B2TQZ9, B2V017, P43731, Q4L3Q7 | P13051 |
| 320 | DVLDTWFSS | Desulfovibrio vulgaris, Geobacter sulfurreducens | Q72E47, Q74BJ6 | P26640 |
| 321 | DVLDTWFSSGL | Helicobacter pylori, Helicobacter pylori | P56000, Q9ZK61 | P26640 |
| 322 | DVLVATDVAS | Helicobacter pylori, Helicobacter pylori | O25029, B9XXL6 | Q9UJV9 |
| 323 | DVLVNNAGI | Acinetobacter sp., Escherichia coli, Escherichia coli, Staphylococcus epidermidis, Staphylococcus epidermidis | P50203, P0A9Q0, P0A9P9, Q8CPI3, Q5HPW0 | P16152 |
| 324 | DVLVNNAGIA | Corynebacterium glutamicum | Q9ZNN8 | P16152 |
| 325 | DVMDGHFVPNIT | Bacillus subtilis | O34557 | Q20D12 |
| 326 | DVSELTGFPE | Rhizobium sp., Rhizobium meliloti | C3MAR5, Q92KX6 | P31939 |
| 327 | DWIVGAGPAGLSAA | Acinetobacter baylyi, Pseudomonas aeruginosa | P94132, Q9HZP5 | Q16134 |
| 328 | DVWEHAYYL | Acinetobacter baylyi, Bacillus anthracis, Bacillus halodurans, Bacillus cereus, Enterococcus faecalis, Escherichia coli, Escherichia coli, Haemophilus influenzae, Haemophilus ducreyi, Listeria innocua, Listeria ivanovii, Listeria monocytogenes, Porphyromonas gingivalis, Pseudomonas putida, Pseudomonas aeruginosa, Staphylococcus epidermidis, Staphylococcus epidermidis, Staphylococcus epidermidis, Staphylococcus carnosus, Staphylococcus saprophyticus, Staphylococcus xylosus, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, | Q59094, Q81LW0, Q9KD10, Q81811, Q83814, P66828, P00448, P43725, O30826, Q92BR6, P28764, P28763, P77929, P19665, P53652, P0C0Q6, Q5HNZ5, Q8VQ15, Q9F326, Q49XZ6, Q9K4V3, Q4L6Q3, P0A0J2, Q6G913, P99098, Q6GGE6, Q5HFK7, P0A0J1, P0A0J3, Q2YT26, Q2FGH0, Q2YUU9, P66831, P66832, Q6GCZ1, Q6GKH2, P66830, Q5HJN5, Q2G261, Q2FKC6, P0DF73, P0DF72, Q8P0D4, Q5XBF8, P0C011, P0C010, P09738, P0A4J5, P0A4J4, P0A4J3 | P04179 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Streptococcus pyogenes, Streptococcus pyogenes, Streptococcus pyogenes, Streptococcus pyogenes, Streptococcus pyogenes, Streptococcus pyogenes, Streptococcus mutans, Streptococcus agalactiae, Streptococcus agalactiae, Streptococcus agalactiae | | |
| 329 | DVWEHAYYLQYKN | Bacillus subtilis | O35023 | P04179 |
| 330 | DVYVNDAFGTAHRA | Ralstonia solanacearum | Q8Y1W6 | P07205 |
| 331 | DVYVNDAFGTAHRAH | Clostridium acetobutylicum | O52632 | P07205 |
| 332 | DWRTKKPVV | Lactobacillus delbrueckii, Lactobacillus delbrueckii | Q041365, Q1GAS8 | Q9N5E4 |
| 333 | DYGPFGFLD | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii | B7L6H9, B6I8R1, Q0THC2, B1I050, B7N544, Q1RB89, Q8FH30, B7MAR7, A1ABP2, B7US45, B7MVI5, B7NTS5, P77649, C4ZYG8, B1XG13, A7ZMH3, A8A0P8, B1LE24, B7LQ82 | Q9BVL4 |
| 334 | DYYEILGVS | Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae | B7LVP7, B1LFU5, Q1RGI7, B6HZ11, B7N7N9, B1IRF9, Q8FLC5, A7ZVV8, B7M0B1, B7NHB7, B7MNM2, Q8XA65, B7L4D9, B7MAD6, B7UI60, A7ZHA5, P08622, B1XBE0, C4ZPU1, B5YYA8, A6T4F5, B5Y241 | Q9NXW2 |
| 335 | DYYEVLGLQ | Clostridium botulinum, Clostridium botulinum, Clostridium perfringens, Haemophilus influenzae, Haemophilus parasuis, Haemophilus ducreyi, Haemophilus influenzae | B2TLZ8, B2V216, Q8XIT1, Q4QJW5, B8F7S3, P48208, P43735 | Q7Z6W7 |
| 336 | EAAPGTIRGD | Bacillus clausii | Q5WGT0 | O00746 |
| 337 | EAAPGTIRGDF | Bacillus cereus, Bacillus cereus, Bacillus thuringiensis, Bacillus anthracis, Bacillus cereus | Q81FQ4, Q73AY0, Q6HL40, Q81SV8, Q63DL7 | O00746 |
| 338 | EAGDGTTTATVLA | Arcobacter butzleri, Pseudomonas stutzeri, Pseudomonas stutzeri | A8ERY3, A4VP82, O33500 | P10809 |
| 339 | EAIKRDFGSF | Bacteroides fragilis | P53638 | P04179 |
| 340 | EALREVSAAR | Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus gordonii, Streptococcus sanguinis, Streptococcus pneumoniae, Streptococcus pneumoniae, Streptococcus pneumoniae, Streptococcus pneumoniae, Streptococcus pneumoniae, Streptococcus pneumoniae | B5XJH4, Q8P2U5, P0DA08, Q9AIQ2, Q1JDW9, P0DA09, Q1JNS7, A2RC98, Q1J8S4, Q5XE49, Q1JIX4, Q48VL2, A8AUJ8, A3CK49, B1ICC8, B8ZK30, C1CES1, Q97QA9, B5E551, B2IP44 | P15313 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 341 | EASGTGNMKFMLNGALT | Streptococcus pneumoniae | P29849 | P06737 |
| 342 | EAYEVLSDA | Pseudomonas aeruginosa, Pseudomonas aeruginosa, Pseudomonas aeruginosa, Pseudomonas aeruginosa, Pseudomonas putida, Pseudomonas putida, Pseudomonas mendocina, Pseudomonas putida, Pseudomonas putida, Pseudomonas syringae, Pseudomonas syringae, Pseudomonas savastanoi | Q9HV44, Q02FR2, B7V1H2, A6VCL7, B0K1S4, B1J255, A4XYF5, Q88DU3, A5W9A2, Q87WP1, Q4ZNP8, Q48E63 | O75190 |
| 343 | EAYEVLSDE | Bacillus cytotoxicus, Staphylococcus saprophyticus, Staphylococcus epidermidis, Staphylococcus epidermidis, Staphylococcus carnosus | A7GT07, Q49Y21, Q5HNW7, Q8CP18, B9DNJ9 | Q96EY1 |
| 344 | EAYEVLSDP | Pseudomonas stutzeri | Q6VAY5 | Q9UDY4 |
| 345 | EAYEVLSDS | Pseudomonas fluorescens | Q4KIH0 | Q8NHS0 |
| 346 | ECKIGIMPG | Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | P99070, P66866, Q5HGI6, Q8NX01, Q6G9W7, Q6GHI9, Q5HPU4, Q8CPH4 | P53597 |
| 347 | EDPVTGSAH | Pseudomonas aeruginosa, Pseudomonas aeruginosa | Q9I073, Q9HY42 | P30039 |
| 348 | EDQIYRIDHYLGK | Bacillus subtilis | P54547 | P11413 |
| 349 | EDRIVKRFL | Sphingomonas wittichii | A5VDD4 | A6NJ78 |
| 350 | EDVKKRI LE | Finegoldia magna | B0S2N4 | P36776 |
| 351 | EEARGDQCD | Bacillus thuringiensis, Bacillus cereus, Bacillus cereus, Bacillus thuringiensis, Bacillus anthracis, Bacillus anthracis, Bacillus anthracis | Q6HBM0, B7JEJ3, C1EYD5, A0RKM3, C3LD96, C3P025, Q81XF9 | P56192 |
| 352 | EEGDLGPVYG | Pseudomonas putida | A5WAK1 | P04818 |
| 353 | EEHDQEGRVI | Bacillus subtilis | P37454 | P27695 |
| 354 | EEIFGPVLVV | Escherichia coli | P23883 | O02252 |
| 355 | EEIKKAYRK | Bacteroides thetaiotaomicron, Bacteroides fragilis, Bacteroides fragilis | Q8A8C3, Q5LED4, Q64VI7 | Q8WW22 |
| 356 | EEMRQSLRI | Streptomyces avermitilis, Streptomyces coelicolor | Q82DX8, Q9XAQ7 | O75306 |
| 357 | EEMRQSLRII | Akkermansia muciniphila, Streptomyces griseus | B2ULZ0, B1W516 | O75306 |
| 358 | EFTQIDIEMSFVD | Desulfovibrio vulgaris | Q72507 | Q6PI48 |
| 359 | EFYMAYADY | Aeromonas hydrophila, Aeromonas salmonicida | A0KNK7, A4SJK0 | Q15046 |
| 360 | EGDSAFGFSGME | Escherichia coli, Escherichia coli | P0AFI0, P0AFI1 | Q9UJ83 |
| 361 | EGGGCSGFQY | Stenotrophomonas maltophilia, Stenotrophomonas maltophilia | B2FJT4, B4SLD1 | Q86U28 |
| 362 | EGGVHRVQRVP | Akkermansia muciniphila | B2UL99 | Q9UGC7 |
| 363 | EGHPDKICD | Corynebacterium aurimucosum | C3PG24 | Q00266 |
| 364 | EGHPDKICDQISD | Bacillus licheniformis, Bacillus halodurans, Bacillus methylotrophicus, Bacillus subtilis, Bacillus pumilus, Bacillus cytotoxicus, Bacillus cereus, Bacillus thuringiensis, Bacillus cereus, Bacillus cereus, Bacillus anthracis, Bacillus cereus, Bacillus anthracis, Bacillus anthracis, Bacillus thuringiensis, Bacillus cereus, Bacillus cereus, Bacillus cereus, Bacillus cereus, Bacillus cereus, Bacillus weihenstephanensis, ptoclostridium difficile | Q65FV8, Q9K7Q9, A7Z7Y9, P54419, A8FGH7, A7GU40, C1EW36, A0RJZ7, B9J265, Q632S5, C3PCC4, B7JT32, Q81KI0, C3LAZ9, Q6HCB4, B7HSV6, B7H9C7, Q8I6Q8, Q72YV6, B7IL28, A9VLC6, QI8CL7 | Q00266 |
| 365 | EGHPDKICDQISDA | Bacillus clausii, Desulfitobacterium hafniense, Bifidobacterium animalis, Clostridium acetobutylicum | Q5WDZ8, B8FSB9, B8DTW8, Q97F85 | Q00266 |
| 366 | EGHPDKICDQISDAVLDA | Clostridium perfringens, Clostridium perfringens, Clostridium botulinum, | Q0SR05, Q0TND4, C1FQQ5, Q898W7, | Q00266 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Clostridium tetani, Clostridium botulinum, Clostridium botulinum, Clostridium botulinum, Clostridium botulinum, Clostridium botulinum, Clostridium phytofermentans, Clostridium thermocellum, Clostridium cellulolyticum* | B1IE45, A5HY62, A7F0I8, A7G9S1, B1KST9, A9KL72, A3DHM4, B8I4C1 | |
| 367 | EGWLAEHMLIL | *Streptomyces avermitilis* | Q82171 | P35558 |
| 368 | EGYNTWGE | *Aggregatibacter actinomycetemcomitans* | P23702 | Q9NUT2 |
| 369 | EGYPGKRYYGG | *Acinetobacter radioresistens, Acinetobacter baylyi, Acinetobacter baumannii, Acinetobacter baumannii, Acinetobacter baumannii, Acinetobacter baumannii, Acinetobacter baumannii, Acinetobacter baumannii, Lactobacillus gasseri, Lactobacillus johnsonii, Lactobacillus brevis, Bacillus methylotrophicus, Lactobacillus fermentum, Bacillus licheniformis, Bacillus pumilus, Bacillus anthracis, Bacillus anthracis, Bacillus anthracis, Bacillus cereus, Bacillus cereus, Desulfitobacterium hafniense, Desulfitobacterium hafniense, Bacteroides thetaiotaomicron, Bacteroides vulgatus, Bacteroides fragilis, Bacteroides fragilis, Campylobacter hominis, Clostridium acetobutylicum, Clostridium thermocellum, Clostridium kluyveri, Clostridium kluyveri, Clostridium cellulolyticum, Clostridium phytofermentans, Desulfovibrio desulfuricans, Enterococcus faecalis, Finegoldia magna, Pediococcus ntosaceus, Porphyromonas gingivalis, Porphyromonas gingivalis, Proteus mirabilis, Pseudomonas stutzeri, Pseudomonas putida, Pseudomonas fluorescens, Pseudomonas aeruginosa, Pseudomonas aeruginosa, Pseudomonas putida, Pseudomonas fluorescens, Pseudomonas fluorescens, Pseudomonas savastanoi, Pseudomonas savastanoi, Pseudomonas syringae, Pseudomonas fluorescens, Pseudomonas syringae, Pseudomonas syringae, Pseudomonas syringae, Ralstonia solanacearum, Ralstonia pickettii, Streptococcus thermophilus, Streptococcus thermophilus* | O85718, Q6FA66, A3M736, B0VBB3, B2HUY9, B7GZR6, B712R7, B0VLF5, Q046F8, Q74LC1, Q03QY0, A7Z9Q9, B2GAT4, Q65DW5, A8FIC1, Q8IJY4, C3P1G5, C3LFJ0, B7JGP1, C1F0N9, Q24MM6, B8FZ69, Q8A9S7, A6L5K3, Q5LD58, Q64U78, A7I3S9, Q97GVI, A3DEB1, A5N7P5, B9E156, B812N8, A9KSH6, B8J189, Q831F9, B0S1N3, Q03EK4, Q7MXW0, B2RGR2, B4EZV5, A4VI36, Q88Q27, Q3K5K9, Q9HTE9, Q9I138, Q88R12, Q4K5R9, Q4K4P6, Q48CP3, Q48DU7, Q4ZNH2, Q3K6J0, Q87WC1, Q4ZM83, Q88AD1, Q8Y1G1, B2U7G7, Q03L77, Q5M0B4 | P34897 |
| 370 | EIAGPGFIN | *Acinetobacter baumannii, Acinetobacter baumannii, Acinetobacter baumannii, Acinetobacter baumannii, Bacillus cereus, Bacillus thuringiensis, Bacillus cereus, Bacillus cereus, Bacillus clausii, Bacillus anthracis, Bacillus halodurans, Propionibacterium acnes, Geobacter daltonii, Geobacter sp., Geobacter bemidjiensis, Haemophilus somnus, Haemophilus influenzae, Haemophilus influenzae, Haemophilus influenzae, Haemophilus ducreyi, Haemophilus influenzae, Pseudomonas fluorescens, Pseudomonas* | B0VBN5, B2I0Y7, B7I1U9, B7H2A9, Q72X85, Q6HAS1, Q81Q08, Q630N6, Q5WB34, Q81JT7, Q9K6C1, Q6A5X8, B9M252, C6E805, B5EEF0, Q0I3B0, A5UCH1, Q40L12, P43832, Q7VP38, A5UJ40, Q3KJB3, C3KAH3, Q4KJK0, B9DKQ7 | P54136 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | fluorescens, Pseudomonas fluorescens, Staphylococcus carnosus | | |
| 371 | EIFLRELISNA | Desulfitobacterium hafniense | Q24VT7 | P14625 |
| 372 | EIFLRELISNASDA | Acinetobacter baylyi, Clostridium perfringens, Clostridium perfringens, Clostridium perfringens | Q6FF82, Q0TU16, Q0VV8, Q8XNC2 | P14625 |
| 373 | EIGGGSIRI | Fusobacterium nucleatum | Q8RGJ4 | Q6PI48 |
| 374 | EIGVASTKA | Neisseria meningitidis, Neisseria meningitidis, Neisseria gonorrhoeae | Q9K1P9, Q9JWN9, Q5F584 | Q06210 |
| 375 | EIKKAYRKLA | Corynebacterium efficiens, Corynebacterium glutamicum, Corynebacterium diphtheriae | Q8FNF5, Q8NNB4, Q6NG14 | Q8WW22 |
| 376 | EKSPYLLQHA | Bacillus subtilis, Bacillus subtilis | P37512, P37509 | Q8TB22 |
| 377 | ELGGKSPLI | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Pseudomonas mendocina, Pseudomonas fluorescens, Pseudomonas syringae, Pseudomonas syringae, Pseudomonas savastanoi, Pseudomonas stutzeri, Rhizobium etli, Rhizobium leguminosarum, Rhizobium etli, Rhizobium sp., Rhizobium meliloti, Rhizobium loti | Q0TKW0, B1J0W5, P17445, B1XET7, A7ZWV5, B7L441, Q7AH91, B5Z1R1, B6I075, B7N8L4, B1LIJ8, Q8FKI8, B7UJG5, A7ZI51, B7MCD1, B7M2V6, B7NK50, A4XPI6, C3K3D2, Q88AE9, Q4ZM62, Q48CM6, A4VKC2, Q2KB42, B5ZUG3, B3PTE1, C3MIE5, P54222, Q985M6 | Q3SY69 |
| 378 | ELGGKSPLII | Acinetobacter baumannii, Acinetobacter baumannii, Acinetobacter baumannii, Acinetobacter baumannii, Acinetobacter baumannii, Acinetobacter baylyi, Acinetobacter baumannii, Klebsiella pneumoniae, Pseudomonas fluorescens, Pseudomonas putida, Pseudomonas entomophila, Pseudomonas putida, Pseudomonas putida, Pseudomonas putida | A3M365, B2HV80, B0V944, B71896, B7GYG4, Q6FDF8, B0VST2, B5Y007, Q3K5H4, B0KN18, Q1IG69, Q88CVV7, A5WA96, B1J2K9 | Q3SY69 |
| 379 | ELGGKSPLIIF | Pseudomonas aeruginosa, Pseudomonas aeruginosa, Pseudomonas aeruginosa, Pseudomonas aeruginosa, Pseudomonas fluorescens | A6VEI4, Q9HTJ1, B7V5R4, Q02DY9, Q4K4K8 | Q3SY69 |
| 380 | ELIASENFAS | Clostridium novyi | A0PZX4 | P34896 |
| 381 | ELLGRVVDALGN | Acinetobacter baylyi, Acinetobacter baumannii, Acinetobacter baumannii, Acinetobacter baumannii, Acinetobacter baumannii, Pseudomonas putida, Pseudomonas putida, Pseudomonas putida, Pseudomonas putida, Pseudomonas fluorescens, Pseudomonas aeruginosa, Pseudomonas aeruginosa, Pseudomonas aeruginosa, Pseudomonas syringae, Pseudomonas fluorescens, Pseudomonas mendocina, Pseudomonas syringae, Pseudomonas savastanoi, Pseudomonas fluorescens, Pseudomonas entomophila, Pseudomonas stutzeri | Q6FFK2, B0VBP5, B7I1W2, B2I100, A3M142, B7H296, A5WBA5, B0KRB0, B1JFU3, Q88BX2, C3K1E8, B7V793, Q02DF2, Q9HT18, A6VF34, Q87TT2, Q3K439, A4Y189, Q4ZL22, Q48BG3, Q4K3A7, Q1I215, A4VS64 | P25705 |
| 382 | ELNRKVLADLA | Clostridium cellulolyticum, Desulfovibrio alaskensis, Desulfovibrio desulfuricans | B8I169, Q30Y14, B8J4E1 | Q9BYC9 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 383 | EMNLSETAF | Bacillus halodurans | Q9KG32 | P30039 |
| 384 | EMRQSLRII | Pseudomonas aeruginosa, Pseudomonas aeruginosa, Pseudomonas aeruginosa | A6V4E7, Q02ND1, Q9I0J9 | O75306 |
| 385 | ENGMDVFRVFD | Propionibacterium freudenreichii | Q70AC7 | P11498 |
| 386 | ENIRRIAEV | Bacteroides fragilis, Bacteroides fragilis, Bacteroides thetaiotaomicron | Q5LES5, Q64VR1, Q8AAQ1 | Q95340 |
| 387 | ENLRWDAS | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus epidermidis, Staphylococcus epidermidis | Q6GDJ1, A8Z5A4, P60336, P60337, A6QK99, Q5HCU1, Q2YWJ5, A5IW37, Q2FV11, Q2FDP9, A7X6Z3, A6U4Z2, Q4L9D7, Q8CMY2, Q5HL11 | Q8NE62 |
| 388 | ENYVHRIGRTGR | Listeria monocytogenes | Q8Y7M8 | Q9UJV9 |
| 389 | EPGAEEKFK | Lactobacillus reuteri, Lactobacillus reuteri | B2G6W4, A5VJE8 | P25685 |
| 390 | EPIGVCGQI | Bacillus subtilis | P71016 | Q94788 |
| 391 | EPTSGNTGI | Escherichia coli, Escherichia coli | P0ABK6, P0ABK5 | P35520 |
| 392 | EPTSGNTGIGLA | Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q6GBX5, P63872, Q6GJF8, P63871, P63870, Q5HIG2, Q8CMT6, Q5HRP1 | P35520 |
| 393 | ERAYDIYSRLL | Fusobacterium nucleatum, Desulfovibrio alaskensis, Desulfovibrio vulgaris, Desulfovibrio vulgaris, Desulfovibrio vulgaris, Desulfovibrio desulfuricans | Q8RHJ8, Q30Z79, A1VE85, Q72CE8, B8DNL4, B8IYM2 | Q16740 |
| 394 | ERAYDIYSRLLR | Desulfovibrio maeticus | C4XH03 | Q16740 |
| 395 | ERFSYYGMRAIL | Bacillus subtilis | P94408 | P46059 |
| 396 | ERGTFSHRH | Staphylococcus haemolyticus, Staphylococcus epidermidis, Staphylococcus epidermidis, Staphylococcus saprophyticus | Q4L6C4, Q5HPC6, Q8CP83, Q49XM5 | Q9ULD0 |
| 397 | ERIPERWHA | Bacillus subtilis, Pseudomonas aeruginosa, Rhizobium meliloti | P42234, Q9I1W8, Q9X576 | P04040 |
| 398 | ERKTGARGLR | Desulfovibrio vulgaris, Desulfovibrio vulgaris | A1VE84, Q72CE7 | O76031 |
| 399 | ERKTGARGLRSI | Streptococcus equi, Streptococcus equi, Streptococcus equi, Streptococcus agalactiae, Streptococcus agalactiae, Streptococcus agalactiae, Streptococcus pyogenes, Streptococcus pyogenes, Streptococcus pyogenes, Streptococcus pyogenes, Streptococcus pyogenes, Streptococcus uberis, Streptococcus mutans, Streptococcus thermophilus, Streptococcus thermophilus, Streptococcus thermophilus, Streptococcus gordonii, Streptococcus sanguinis, Streptococcus pneumoniae, Streptococcus pneumoniae, Streptococcus pneumoniae, Streptococcus pneumoniae, Streptococcus pneumoniae, Streptococcus pneumoniae, | B4U360, C0M9R7, C0MEW5, Q8DZ10, Q8E4L8, Q3K0K0, A2RF17, Q5XCM0, Q1JC93, Q1JM77, B5XL03, B9DU73, Q8DUI0, Q03LN0, Q5M5B0, Q5M0S4, A8AX69, A3CMV1, B5E6L2, B8ZLT1, B2IR87, C1CLR8, C1CFF2, P63792, P63791, C1C8G0, Q04JH9 | O76031 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
|  |  | *Streptococcus pneumoniae, Streptococcus pneumoniae, Streptococcus pneumoniae* |  |  |
| 400 | ERLEFLGDAV | *Bifidobacterium longum* | Q8G7H1 | Q9NRR4 |
| 401 | ESMLTGESVPV | *Enterococcus hirae* | P32113 | Q9H7F0 |
| 402 | ESVKAASELY | *Desulfovibrio vulgaris, Desulfovibrio vulgaris, Desulfovibrio alaskensis* | A1VE01, Q72C58, Q311A6 | P23434 |
| 403 | ESVKAASELYSPL | *Desulfovibrio vulgaris* | B8DP97 | P23434 |
| 404 | ESVRGKDVFIIQ | *Campylobacter jejuni* | Q9PP15 | O60256 |
| 405 | ETGGLSGKPL | *Rhizobium loti* | Q98689 | Q02127 |
| 406 | ETLGGTCLNVGC | *Pseudomonas aeruginosa* | Q9HUY1 | P09622 |
| 407 | ETMLGDVAV | *Ralstonia solanacearum* | Q8XX80 | P26640 |
| 408 | ETMLGDVAVAVHP | *Corynebacterium jeikeium, Corynebacterium efficiens, Corynebacterium diphtheriae, Corynebacterium glutamicum* | Q4JWU8, Q8FN65, Q6NFV0, Q8NN37 | P26640 |
| 409 | ETRYRQRYLDLI | *Edwardsiella ictaluri, Proteus mirabilis* | C5BAR6, B4F0M6 | Q15046 |
| 410 | ETVGVGQSE | *Escherichia coli* | P27254 | Q8IVH4 |
| 411 | ETYGCQMNV | *Bacteroides vulgatus, Parabacteroides distasonis, Bacteroides thetaiotaomicron, Bacteroides fragilis, Bacteroides fragilis, Porphyromonas gingivalis, Porphyromonas gingivalis* | A6KZJ2, A6LEM6, Q8A2W0, Q650P7, Q5LJ70, Q7MAW4, B2RKG6 | Q965Z6 |
| 412 | EVAKLFADAG | *Clostridium acetobutylicum* | Q97MT8 | Q43252 |
| 413 | EVEGLADLI | *Rhizobium meliloti, Rhizobium etli, Rhizobium leguminosarum, Rhizobium etli* | Q92KW1, B3PS53, Q1MA18, Q2K2S0 | Q969Y2 |
| 414 | EVGPRDGLQNE | *Bacillus subtilis, Pseudomonas mevalonii* | Q34873, P13703 | Q8TB92 |
| 415 | EVRGGGRKP | *Corynebacterium glutamicum, Corynebacterium glutamicum, Corynebacterium aurimucosum* | Q8NT08, A4QB10, C3PKQ3 | Q9BYD3 |
| 416 | EVRGGGRKPW | *Bacillus clausii, Bacillus halodurans, Bacillus licheniformis, Bacillus weihenstephanensis, Bacillus thuringiensis, Bacillus cereus, Bacillus cereus, Bacillus cereus, Bacillus thuringiensis, Bacillus cereus, Bacillus cereus, Bacillus cereus, Bacillus cereus, Bacillus anthracis, Bacillus cereus, Bacillus cereus, Bacillus anthracis, Bacillus anthracis, Bacillus subtilis, Bacillus methylotrophicus, Bacillus pumilus, Desulfitobacterium hafniense, Desulfitobacterium hafniense, Eubacterium rectale, Clostridium thermocellum, Finegoldia magna, Listeria innocua, Listeria monocytogenes, Listeria monocytogenes, Listeria monocytogenes, Listeria welshimeri* | Q5WLR1, Q9Z9L3, Q65PA6, A9VP78, Q6HPQ7, Q63H89, Q81J41, B9IZJ5, A0R8I1, B7HQU5, B7IT20, B7HJ49, C1ET40, Q81VS9, Q73F95, B7JKC0, C3LJ83, C3P9Q6, P42921, A7ZQN9, A8F986, B8G1W7, Q250N1, C4ZBD5, A3DJH3, B0RZU1, P61054, P61055, B8DB09, Q71WE7, C1KZH9, A0ALW7 | Q9BYD3 |
| 417 | EVTLLGQNVN | *Corynebacterium urealyticum, Corynebacterium glutamicum, Corynebacterium glutamicum, Corynebacterium diphtheriae, Corynebacterium efficiens, Corynebacterium jeikeium, Pseudomonas aeruginosa, Pseudomonas aeruginosa, Pseudomonas aeruginosa, Pseudomonas savastanoi, Pseudomonas syringae, Pseudomonas fluorescens, Pseudomonas fluorescens, Pseudomonas syringae, Ralstonia pickettii, Ralstonia solanacearum, Rhizobium loti* | B1VDD8, A4QEV7, Q8NP67, Q6NGR0, Q8FPD5, Q4JV79, A6V0C9, Q51470, Q02SE8, Q48DN8, Q4ZN97, Q4K5I3, Q3K6B7, Q87VY1, B2UFP3, Q8Y206, Q98BK3 | Q96SZ6 |
| 418 | EVTLLGQNVNS | *Desulfitobacterium hafniense, Geobacter metallireducens, Geobacter bemidjiensis* | Q24X58, Q39TA3, B5EE49 | Q96SZ6 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 419 | EWWNDLWLNE | Streptomyces lividans | Q11010 | P15144 |
| 420 | EYCLGPTHEE | Desulfovibrio desulfuricans | B8IZD1 | Q7L3T8 |
| 421 | EYCLGPTHEEA | ptoclostridium difficile | Q18CD2 | Q7L3T8 |
| 422 | EYLARWFD | Corynebacterium efficiens, Corynebacterium glutamicum | Q8FTA8, Q8N098 | P21399 |
| 423 | EYRGYDSAG | Fusobacterium nucleatum | Q8RG65 | Q06210 |
| 424 | EYSRSGNPTR | Helicobacter pylori, Helicobacter pylori, Helicobacter pylori | P56069, Q1M0P5, Q9ZMW7 | P32929 |
| 425 | FALCGFANF | Escherichia coli, Escherichia coli | P33021, P33024 | O00377 |
| 426 | FALCGFANFSSI | Bacillus subtilis | O32115 | O00377 |
| 427 | FALKPMNCPGH | Rhizobium loti, Rhizobium sp., Rhizobium etli, Rhizobium etli, Rhizobium leguminosarum, Rhizobium meliloti | Q98LR2, C3MB49, Q2K859, B3PNV4, B5ZQK2, Q92Q130 | A2RTX5 |
| 428 | FANFSSIGI | Bacillus subtilis, Escherichia coli, Escherichia coli | P39141, P0AFF2, P0AFF3 | O00377 |
| 429 | FAPEVAWVT | Bacillus cereus, Bacillus cereus, Bacillus thuringiensis, Bacillus cereus, Bacillus thuringiensis, Bacillus anthracis, Eubacterium rectale, Clostridium novyi, Clostridium cellulolyticum, Clostridium botulinum, Clostridium botulinum, Clostridium botulinum, Clostridium botulinum, Clostridium botulinum, Clostridium botulinum, Clostridium sticklandii, Clostridium phytofermentans, ptoclostridium difficile, Eubacterium eligens | Q81IE9, Q63GI2, Q6HNZ7, Q73E50, A0R9A0, Q81Z76, C4ZC24, A0Q213, B8I5R4, C3KUV8, B1L224, B1IF12, A7GIT0, C1FM10, A51768, A7FYU0, Q9L4Q8, A9KL35, Q18CD7, C4Z1D7 | P07814 |
| 430 | FCAGADLKER | Bacillus subtilis | O34893 | Q13825 |
| 431 | FCKEFNERTKD | Selenomonas ruminantium | Q84IF5 | Q9Y3B7 |
| 432 | FDPLDGSSNID | Acinetobacter baumannii, Acinetobacter baumannii, Acinetobacter baumannii, Acinetobacter baumannii, Desulfovibrio vulgaris, Desulfovibrio vulgaris, Desulfovibrio salexigens, Desulfovibrio alaskensis, Neisseria meningitidis, Neisseria meningitidis, Neisseria meningitidis, Neisseria meningitidis, Neisseria gonorrhoeae, Neisseria gonorrhoeae, Pseudomonas stutzeri, Pseudomonas aeruginosa, Pseudomonas mendocina, Pseudomonas aeruginosa, Pseudomonas aeruginosa, Pseudomonas aeruginosa, Pseudomonas putida, Pseudomonas putida, Pseudomonas putida, Pseudomonas entomophila, Pseudomonas putida, Pseudomonas fluorescens, Pseudomonas fluorescens, Pseudomonas fluorescens, Pseudomonas syringae, Pseudomonas syringae, Pseudomonas savastanoi, Ralstonia pickettii, Ralstonia solanacearum, Stenotrophomonas maltophilia, Stenotrophomonas maltophilia | A3M7W9, B0VDK0, B0VT80, B2HWU2, A1VD23, Q72AZ9, C6BTU7, Q30ZN0, Q9JZH1, A1KTU6, A1IRQ3, A9LYX9, Q5F8C3, B4RLD4, A4VGC9, Q02EQ6, A4XPL2, Q9HU73, B7V3K3, A6VDM7, B1J2P7, B0KM65, A5WA74, Q1I3Q0, Q88CY9, Q3KJG0, C3K7D6, Q4KJP6, Q87UX4, Q4ZZI0, Q48PL3, B2U8C4, Q8XXI7, B2FU10, B4SR24 | P09467 |
| 433 | FDRERIPERVVHA | Pseudomonas aeruginosa, Pseudomonas syringae | Q59635, P46206 | P04040 |
| 434 | FDRERIPERVVHAKG | Helicobacter pylori, Helicobacter pylori | Q9ZKX5, P77872 | P04040 |
| 435 | FDRILASRMGV | Haemophilus ducreyi | Q8GNC1 | Q01813 |
| 436 | FDRILLDAPCS | Escherichia coli | Q0TCH3 | Q8TEA1 |
| 437 | FDTAPTGHT | Escherichia coli, Escherichia coli | P52145, P08690 | Q43681 |
| 438 | FEYVYFARPDS | Escherichia coli, Rhizobium etli | P0AG16, P77935 | Q06203 |
| 439 | FFYPLDFTFVCPTEl | Clostridium pasteurianum | P23161 | Q06830 |
| 440 | FGHPEVYIL | Bacillus pseudofirmus, Bacillus sp. | Q04440, P16262 | P00395 |
| 441 | FGHPEVYILILP | Bacillus subtilis | P24010 | P00395 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 442 | FGICLGHQL | Listeria monocytogenes, Listeria monocytogenes, Listeria innocua | Q71YI0, Q8Y664, Q92AH2 | P27708 |
| 443 | FGLGAEVGIST | Arcobacter butzleri | A8EVN0 | P54886 |
| 444 | FGLPAENAA | Fusobacterium nucleatum, Desulfitobacterium hafniense, Desulfitobacterium hafniense, ptoclostridium difficile | Q8RIQ3, Q24SP5, B8FUR3, Q182K8 | Q15031 |
| 445 | FGMGCFWGAER | Pseudomonas aeruginosa, Pseudomonas aeruginosa, Pseudomonas aeruginosa, Pseudomonas syringae, Rhizobium mel iloti | Q02EZ9, Q9HUF1, B7V3B1, Q4ZM24, Q92SY7 | Q9UJ68 |
| 446 | FGMIPEFVGR | Clostridium phytofermentans | A9KSX1 | O76031 |
| 447 | FGSFDKFKE | Pseudomonas aeruginosa, Pseudomonas putida, Pseudomonas putida | P53641, Q88PD5, P09223 | P04179 |
| 448 | FGTGAVKITPAHD | Lactobacillus casei, Clostridium acetobutylicum, Clostridium tetani, Clostridium perfringens | P36420, Q97GG8, Q891R5, | P26640 Q8XJ42 |
| 449 | FGTIDSWLIW | Streptomyces avermitilis | Q827G1 | Q14409 |
| 450 | FGWDCHGLP | Corynebacterium diphtheriae, Corynebacterium jeikeium | Q6NGD7, Q4JW85 | P41252 |
| 451 | FHAIYWPAFL | Campylobacter jejuni, Helicobacter pylori, Helicobacter pylori | Q9PP85, Q9ZKG9, P56127 | Q96GW9 |
| 452 | FHSLEDRIVK | Methylobacterium sp., Fusobacterium nucleatum, ptoclostridium difficile, Clostridium thermocellum, Clostridium beijerinckii, Clostridium botulinum, Clostridium botulinum, Clostridium tetani, Clostridium acetobutylicum, Methylobacterium radiotolerans, Methylobacterium extorquens, Methylobacterium extorquens, Methylobacterium extorquens, Methylobacterium populi, Methylobacterium nodulans, Neisseria meningitidis, Neisseria meningitidis, Neisseria meningitidis, Neisseria gonorrhoeae, Neisseria meningitidis, Neisseria gonorrhoeae | B0UFI0, Q8R6F5, Q182Z2, A3DE34, A6LTS0, B2TS30, B2V4W0, Q89464, Q97H81, B1LYT9, B7KU77, C5ATZ5, A9WV37, B1Z8U3, B8IMX2, A1KVM4, Q9JSY9, Q9KOZ0, B4RQD7, A9M2I4, Q5F6K7 | A6NJ78 |
| 453 | FHSLEDRIVKRF | Rhizobium loti | Q98KA5 | A6NJ78 |
| 454 | FIAGADINM | Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Klebsiella pneumoniae, Klebsiella pneumoniae | A8ADP2, A4WCVV6, Q8FFG4, B7LBJ5, A7ZPF8, B61604, B7M6M2, Q8XCP2, B7NP24, B7N5V2, B1LME7, B7MGV7, Q1R972, A1ADI8, A8A2L0, B7UFZ8, B1IXA5, B7MY16, B5YXY4, Q0TFA6, P77399, B1X9L4, C4ZVN2, B7LLD0, B5XWV2, A6TC19 | P40939 |
| 455 | FIGRSNVGKSSLI | Parabacteroides distasonis, Porphyromonas gingivalis, Porphyromonas gingivalis | A6LBY4, Q7MX68, B2RL89 | Q8N3Z3 |
| 456 | FITHLHGDH | Lactobacillus casei, Lactobacillus casei | B3WE54, Q039J0 | Q9H777 |
| 457 | FITPVPGGVGPMT | Listeria monocytogenes, Listeria monocytogenes | Q71ZW2, C1L2R6 | P11586 |
| 458 | FITPVPGGVGPMTVAMLMQ | Haemophilus parasuis | B8F605 | P11586 |
| 459 | FKQLLMVGG | Acinetobacter baumannii, Acinetobacter baumannii, Acinetobacter baumannii, Acinetobacter baumannii, Acinetobacter baumannii, Acinetobacter baumannii, Bacillus cytotoxicus, Bacillus cereus, Bacillus cereus, Bacillus cereus, Bacillus | B0V550, B2HYL7, B7I8M5, B7GWN1, A3M8Q6, B0VRC7, A7GT84, B9IYX5, B7HQG0, Q730D1, Q634E3, B7HE37, B7IIR4, Q81LI7, C3P990, Q6HDC3, | Q6PI48 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | cereus, Bacillus cereus, Bacillus cereus, Bacillus anthracis, Bacillus anthracis, Bacillus thuringiensis, Bacillus cereus, Bacillus thuringiensis, Bacillus cereus, Bacillus anthracis, Bacillus cereus, Bacillus weihenstephanensis, Corynebacterium kropnstedtii, Helicobacter pylori, Helicobacter pylori, Helicobacter pylori, Helicobacter pylori | C1ESU7, A0RJ11, B7JPY8, C3L608, Q817X8, A9VIM8, C4LIW2, P56459, Q1CTQ7, B6JLK1, Q9ZLL9 | |
| 460 | FKQLYDKGL | Bifidobacterium longum | Q8G3I2 | P41252 |
| 461 | FLKHIERTR | Clostridium botulinum | B2TK70 | A4D1E9 |
| 462 | FLRELISNASDA | Aeromonas hydrophila, Aeromonas salmonicida, Bacillus lichen iformis | A0KL53, A4SLY0, Q65CZ5 | P14625 |
| 463 | FLRHIERCR | Propionibacterium acnes | Q6A9H8 | Q9H4K7 |
| 464 | FLSNGPGDP | Haemophilus ducreyi, Neisseria meningitidis, Neisseria meningitidis, Neisseria gonorrhoeae, Pseudomonas syringae, Pseudomonas putida, Pseudomonas aeruginosa, Ralstonia solanacearum, Rhizobium loti | Q7VP66, Q9JXX4, Q9JVZ6, Q50983, Q87WP3, Q88DU5, P38098, Q8XZ85, Q981A7 | P27708 |
| 465 | FLSNGPGDPA | Acinetobacter baylyi, Desulfovibrio vulgaris, Desulfovibrio vulgaris, Escherichia coli, Escherichia coli, Escherichia coli, Rhizobium meliloti | Q6F8M7, A1VA26, Q726J4, Q8FLB1, P0A6F2, P0A6F1, Q92N95 | P27708 |
| 466 | FLSQSGETAD | Bacillus subtilis, Bacillus subtilis | EOU070, P0CI73 | Q06210 |
| 467 | FLWVVDFPL | Uncultured termite | B1GZY6 | Q6PI48 |
| 468 | FMPVGTQAT | Clostridium thermocellum, Pediococcus ntosaceus, Streptococcus suis, Streptococcus suis, Streptococcus pneumoniae, Streptococcus agalactiae, Streptococcus agalactiae, Streptococcus agalactiae, Streptococcus gordonii, Streptococcus thermophilus, Streptococcus thermophilus, Streptococcus thermophilus, Streptococcus sanguinis, Streptococcus uberis, Streptococcus equi, Streptococcus pneumoniae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus equi, Streptococcus pyogenes, Streptococcus pyogenes, Streptococcus pyogenes, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pyogenes, Streptococcus mutans | A3DE13, Q03ER2, A4VW51, A4W2F8, B1I9B4, Q8E1F9, Q8E6X6, Q3K2Y7, A8AUL3, Q5M2K9, Q03IQ5, Q5LY05, A3CK60, B9DVZ9, C0MAH5, C1CN05, Q1JIT0, P0DF87, Q48VG9, A2RCC9, Q1JNN4, Q1JDS0, P66910, P0DF86, C0MEV8, Q9A1L6, Q1J8P1, B5XJL3, C1CGY8, B2IMN3, P66908, B5E2X9, P66907, B8ZPB8, Q04163, C1CTW4, C1CAA6, Q5XE18, Q8DVZ3 | Q9BXR0 |
| 469 | FMQKEIFEQP | Ralstonia solanacearum | Q8Y303 | Q06210 |
| 470 | FNDDIQGTA | Pseudomonas aeruginosa, Pseudomonas aeruginosa, Pseudomonas aeruginosa, Pseudomonas aeruginosa | Q9HYD5, Q02QW0, B7UWK9, A6V1V5 | Q16798 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 471 | FNDDIQGTASVAV | Pseudomonas savastanoi, Pseudomonas syringae, Pseudomonas syringae | Q48LC8, Q4ZW63, Q87Y79 | Q16798 |
| 472 | FPAGILQAPFY | Lactobacillus helveticus | O52071 | Q60344 |
| 473 | FPGYTHLQRAQPI | Bacillus pumilus | A8FG69 | P04424 |
| 474 | FPHHENEIAQ | Corynebacterium kropnstedtii, Streptomyces avermitilis, Streptomyces griseus, Streptomyces coelicolor | C4LH17, Q82GD0, B1VS94, Q9L0Q6 | Q9HA77 |
| 475 | FPLLTTKRV | Bacillus cytotoxicus, Bacillus thuringiensis, Bacillus thuringiensis, Bacillus anthracis, Bacillus cereus, Bacillus cereus, Bacillus cereus, Enterococcus faecalis, Pediococcus ntosaceus | A7GP90, Q6HJC7, A0RDL9, Q81R23, Q81E05, Q738X7, Q63BV5, Q834R3, Q03F96 | P04818 |
| 476 | FPLWWQTGSGTQ | Bacillus subtilis, Methylobacterium extorquens, Neisseria meningitidis, Pseudomonas syringae, Pseudomonas putida, Ralstonia solanacearum | P07343, Q8KTE1, Q9JTR0, Q885V0, Q88M20, Q8X0E8 | P07954 |
| 477 | FQALRIFVN | Rhizobium etli, Rhizobium leguminosarum, Rhizobium sp., Rhizobium etli, Rhizobium meliloti, Rhizobium leguminosarum, Rhizobium leguminosarum | Q2K6B3, Q1ME25, C3MEN7, B3PTW8, Q92NL4, B5ZWK2, C6ARU7 | A6NJ78 |
| 478 | FRASPRQSD | Helicobacter hepaticus | Q7VFS3 | O75251 |
| 479 | FRASPRQSDVMI | Helicobacter pylori, Helicobacter pylori, Helicobacter acinonychis, Helicobacter pylori, Helicobacter pylori, Helicobacter pylori | B6JNA1, B5Z8Q6, Q17Z53, O25851, B2UV25, Q1CS00, Q9ZJW6 | O75251 |
| 480 | FRPWTIRQYAGFST | Propionibacterium freudenreichii | P11653 | P22033 |
| 481 | FSMCEHHLVPF | Bacillus halodurans | Q9KCC7 | P30793 |
| 482 | FSMDGDIAPL | Escherichia coli, Ralstonia pickettii, Ralstonia solanacearum, Stenotrophomonas maltophilia, Stenotrophomonas maltophilia | B7LC58, B2UBJ3, Q8XZC3, B2FLM5, B4SM82 | Q75600 |
| 483 | FTFGPTFRAE | Lactobacillus plantarum, Lactobacillus helveticus, Lactobacillus delbrueckii, Lactobacillus johnsonii, Lactobacillus gasseri | Q88Y40, A8YVJ7, P54262, Q74JA9, Q043G9 | Q96159 |
| 484 | FTSGATESNN | Aeromonas salmonicida, Neisseria meningitidis | A4SP14, Q9JYY0 | Q9Y697 |
| 485 | FTSGGTESN | Bacillus subtilis | P38033 | Q96115 |
| 486 | FTSGGTESNN | Lactobacillus delbrueckii, Rhizobium sp. | P31672, P55690 | Q96115 |
| 487 | FTTWADTGDF | Pseudomonas syringae, Pseudomonas syringae, Pseudomonas savastanoi | Q884H4, Q4ZV64, Q48KH5 | P37837 |
| 488 | FVCLGNICRSP | Staphylococcus haemolyticus, Staphylococcus aureus, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q4L7J1, Q6GFH6, Q49Y56, Q6G853, Q7A0I2, Q2FX12, P0Q5D2, Q7A4S1, Q5HEP3, Q99T00, Q2FFL4, Q2YU46, Q8CNQ1, Q5HN53 | P24666 |
| 489 | FVPNDMQVGQTGKIVAP | Pseudomonas aeruginosa | Q9HZP7 | P13804 |
| 490 | FWVGPEAPL | Rhizobium meliloti | Q92RL0 | P22102 |
| 491 | FYAAVEMRDNP | Aeromonas hydrophila, Citrobacter koseri | A0KHD5, A8AKQ2 | Q9UBT6 |
| 492 | FYDGPPFATGLPHYGHIL | Pseudomonas fluorescens | Q8L1B1 | P41252 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 493 | FYGPFRDAA | Bacillus subtilis, Bacillus halodurans | P30950, Q9K8G2 | P13716 |
| 494 | FYQASTSELYG | Rhizobium fredii, Rhizobium sp. | O85713, P55354 | Q60547 |
| 495 | GACVNAPMV | Rhizobium meliloti | P56909 | P19404 |
| 496 | GAFTGEISP | Bacillus licheniformis, Bacillus subtilis, Bacillus halodurans, Listeria innocua, Listeria monocytogenes, Listeria monocytogenes | Q65EN0, P27876, Q9K715, Q928I1, Q71WW9, Q8Y4I3 | P60174 |
| 497 | GAFTGEISPGM | Geobacter metallireducens | Q39U97 | P60174 |
| 498 | GAFYGPKIDI | Helicobacter hepaticus | Q7VJO9 | P26639 |
| 499 | GAFYGPKIDIKI | Campylobacter lari | B9KEB1 | A2RTX5 |
| 500 | GAGDQGLMFG | Lactobacillus sakei, Lactobacillus fermentum, Lactobacillus helveticus, Lactobacillus acidophilus, Lactobacillus johnsonii, Enterococcus faecalis, Geobacter sp., Listeria monocytogenes, Listeria monocytogenes, Listeria monocytogenes, Listeria innocua, Listeria welshimeri, Rhizobium loti, Staphylococcus carnosus, Streptococcus sanguinis, Streptococcus mutans, Streptococcus thermophilus, Streptococcus gordonii, Streptococcus thermophilus, Streptococcus suis, Streptococcus suis, Streptococcus equi, Streptococcus equi, Streptococcus equi, Streptococcus uberis, Streptococcus pneumoniae, Streptococcus pneumoniae, Streptococcus pneumoniae, Streptococcus pneumoniae, Streptococcus pneumoniae, Streptococcus pneumoniae, Streptococcus agalactiae, Streptococcus pneumoniae, Streptococcus pneumoniae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pneumoniae, Streptococcus pneumoniae, Streptococcus agalactiae, Streptococcus agalactiae, Streptococcus pyogenes, Streptococcus pyogenes, Streptococcus pneumoniae, Streptococcus pyogenes | Q38YF8, B2GDG2, A8YWU7, Q5FIN8, Q74K54, Q837P9, C6E2L2, B8DFQ7, Q71Z03, C1KVW3, Q8Y6M0, Q92AZ5, A0AJB9, Q98A80, B9DN19, A3CNY4, Q8DT23, Q5LZI0, A8AWW6, Q5M434, A4W351, A4VWU8, C0M9M7, B4U228, C0MCM1, B9DSM6, Q8DQH0, B2INE5, B1IAT8, B5E364, Q04LE0, B8ZNB7, Q8E5Y0, C1C6A5, C1CJL0, B5XM14, A2RE06, Q1JL80, Q1JB36, Q8P0G6, P0DF55, P0DF54, Q5XBJ6, Q485U7, C1CQM2, Q97RN9, Q8E0A3, Q3K1M7, Q99Z77, Q1J626, C1CDB0, Q1JGA1 | Q00266 |
| 501 | GAGDQGLMFGYA | Acinetobacter baylyi, Acinetobacter baumannii, Acinetobacter baumannii, Acinetobacter baumannii, Acinetobacter baumannii, Lactobacillus brevis, Geobacter uraniireducens, Geobacter metallireducens, Geobacter sulfurreducens, Neisseria meningitidis, Neisseria meningitidis, Neisseria meningitidis, Neisseria gonorrhoeae, Neisseria gonorrhoeae, Ralstonia solanacearum, Ralstonia pickettii, Streptomyces sctabilis | Q6FA06, B0VC98, A3M4V2, B0VR30, B2HYY9, Q03QA4, A5GA66, Q39W48, P61946, AIK598, A9M1V8, Q9JW6, Q9JY09, Q5FAC0, B4R036, Q8Y347, B2UD22, Q9X4Q2 | Q00266 |
| 502 | GAGDQGLMFGYAT | Pediococcus ntosaceus, Staphylococcus aureus, Staphylococcus aureus, | Q03GG8, Q8NVZ9, A8Z4L2, Q2G1W4, Q6G8E3, A6QHX0, | Q00266 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus saprophyticus | Q5HEY9, Q2YTK1, Q2FFV6, P50307, P66767, P66766, A5ITV6, A6U2Q1, A7X3N2, Q6GFR6, Q4L7C7, Q49YL6 | |
| 503 | GAGDQGLMFGYATDET | Lactobacillus reuteri, Lactobacillus reuteri, Staphylococcus epidermidis, Staphylococcus epidermidis, Streptomyces avermitilis | B2G8G3, A5VL29, Q8CNT5, Q5HNB8, Q827Q0 | Q00266 |
| 504 | GAGGQHVNKT | Methylobacterium sp., Methylobacterium nodulans, Methylobacterium extorquens, Methylobacterium extorquens, Methylobacterium populi, Methylobacterium radiotolerans | B0UAV4, B8IUB4, A9W1A4, B7L246, B1Z914, B1M766 | Q75570 |
| 505 | GAGGQHVNKTDSA | Pseudomonas stutzeri | A4VPB9 | Q75570 |
| 506 | GAGHFVKMVHNG1EY | Bacillus licheniformis | P52207 | P52209 |
| 507 | GAGISTESGIPDYR | Streptomyces coelicolor | Q9RL35 | Q9Y6E7 |
| 508 | GAGKTTVGR | Acinetobacter baumannii, Acinetobacter baumannii, Acinetobacter baylyi, Ralstonia solanacearum, Streptococcus gordonii | B0V8M8, B0V033, Q6F7E4, Q8XV61, A8AXY8 | Q81Y07 |
| 509 | GAGVSAESG | Pseudomonas aeruginosa | Q9I4L0 | Q9NXA8 |
| 510 | GAGVSAESGVPTFR | Ralstonia solanacearum | Q8Y015 | Q9NXA8 |
| 511 | GAHIYVCGDA | Neisseria meningitidis, Neisseria meningitidis, Neisseria meningitidis, Neisseria meningitidis | A1KU06, Q9JUD8, A9LZ73, Q9J545 | P16435 |
| 512 | GAHTDSPCLRVK | Pseudomonas stutzeri, Pseudomonas mendocina, Pseudomonas syringae, Pseudomonas fluorescens, Pseudomonas savastanoi, Pseudomonas syringae, Pseudomonas fluorescens, Pseudomonas aeruginosa, Pseudomonas putida, Pseudomonas aeruginosa, Pseudomonas entomophila, Pseudomonas aeruginosa, Pseudomonas aeruginosa, Pseudomonas putida, Pseudomonas putida, Pseudomonas putida | A4VJG1, A4XRN0, Q4ZW15, C3K0D7, Q48L80, Q87YC5, Q3KFM3, Q02Q78, B0KTU0, A6V2H4, Q1IDE6, Q9HYZ3, B7V7X2, B1J1S3, Q88M44, A5W7K3 | Q9ULA0 |
| 513 | GAHVNPAVT | Haemophilus influenzae | O86231 | P30301 |
| 514 | GANAILGVS | Enterococcus faecalis, Enterococcus faecalis, Enterococcus hirae, Streptococcus mutans, Streptococcus uberis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, | E6ER18, P0DM31, Q8GR70, Q8DT59, B9DRR9, Q1JML5, Q1JCN8, B5XKM7, P0DA95, Q48UF7, A2RFE3, Q1J7I5, P69951, Q1JHQ6, P0DA94, P69949, Q5XD01, P64081, Q3K2B2, P64080, A4W2T1, C0MH89, B4U2B8, C0M6K5, C1CRM6, C1CKJ0, C1OEB3, Q97QS2, B8ZPW9, B1IBR3, | P06733 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus agalactiae, Streptococcus agalactiae, Streptococcus agalactiae, Streptococcus suis, Streptococcus equi, Streptococcus equi, Streptococcus equi, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus sanguinis, Streptococcus pneumoniae, Streptococcus pneumoniae, Streptococcus pneumoniae* | C1C7C0, B5E4P1, A3CMA7, Q8DPS0, B2IPX8, Q04KG2 | |
| 515 | GANAILGVSLA | *Bifidobacterium longum, Bifidobacterium longum* | B3DSV2, Q8G5I9 | P06733 |
| 516 | GAPGSGKGT | *Porphyromonas gingivalis, Porphyromonas gingivalis* | Q7MW54, B2RIY8 | Q9UIJ7 |
| 517 | GAPNAGKSTL | *Rhizobium loti* | Q985A5 | Q75616 |
| 518 | GAPPHGGIA | *Propionibacterium acnes* | Q6A8J1 | Q6PI48 |
| 519 | GAQWGDEGKGK | *Bifidobacterium longum, Bifidobacterium longum, Bifidobacterium longum, Bifidobacterium adolescentis, Corynebacterium ammoniagenes, Methylobacterium sp., Bifidobacterium animalis, Corynebacterium efficiens, Corynebacterium diphtheriae, Corynebacterium glutamicum, Corynebacterium glutamicum, Corynebacterium aurimucosum, Corynebacterium jeikeium, Corynebacterium urealyticum, Desulfovibrio alaskensis, Desulfovibrio vulgaris, Desulfovibrio vulgaris, Desulfovibrio vulgaris, Desulfovibrio desulfuricans, Kocuria rhizophila, Methylobacterium radiotolerans, Methylobacterium extorquens, Methylobacterium populi, Methylobacterium nodulans, Micrococcus luteus, Sphingomonas wittichii* | Q8G6T9, B3DNT3, B7GT29, A0ZZG5, Q9RHX5, B0UJ78, B8DVC2, Q8FMB0, Q6NF38, Q8NM16, A4QHG2, C3PJK0, Q4JXT3, B1VHT9, Q31769, B8DQ18, A1V9U1, Q725K9, B8J4N1, B2GL12, B1M1K0, B7L289, B1Z962, B8IPM5, C5C8H9, A5VFF3 | Q8N142 |
| 520 | GAQWGDEGKGKVVD | *Geobacter sulfurreducens, Geobacter metallireducens, Geobacter daltonii, Geobacter uraniireducens, Geobacter lovleyi, Geobacter sp., Geobacter bemidjiensis* | Q747F9, Q39QK1, B9M1R2, A5GC19, B3EAS4, C6DZQ7, B5ECF3 | Q8N142 |
| 521 | GASGDLAPL | *Clostridium tetani, Streptococcus sanguinis, Streptococcus gordonii, Streptococcus pyogenes, Streptococcus pyogenes, Streptococcus pyogenes, Streptococcus pyogenes, Streptococcus pyogenes, Streptococcus pyogenes* | Q891Q1, A3CL24, A8AZ70, A2RGS5, Q8NZ46, Q5X9K4, B5XIY2, P58083, P0DB75, P0DB74 | P42357 |
| 522 | GASGDLAPLSH | *Streptomyces globisporus* | Q8GMG0 | P42357 |
| 523 | GASGDLAPLSHLAL | *Bacillus clausii, Bacillus subtilis, Staphylococcus saprophyticus* | Q5WAZ6, P10944, Q4A173 | P42357 |
| 524 | GAVKITPAHD | *Bacillus licheniformis, Bacillus halodurans, Bacillus subtilis, Bacillus clausii, Listeria innocua, Listeria monocytogenes, Listeria monocytogenes* | Q65GK8, Q9K8G8, Q05873, Q5WEQ4, Q92BG2, Q8Y6X9, Q71ZB6 | P26640 |
| 525 | GCCPGGTASN | *Bacillus subtilis* | O34524 | Q12908 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 526 | GCFWGAERKFW | Methylobacterium sp., Methylobacterium nodulans, Streptomyces griseus | B0UCG5, B8IJD1, B1W2P8 | Q9UJ68 |
| 527 | GCIPSKALL | Bacillus subtilis | P54533 | P09622 |
| 528 | GCMKGRTMYVIPFSMGP | Clostridium thermocellum | A3DJE3 | P35558 |
| 529 | GCMKGRTMYVIPFSMGPLGSP | Geobacter sulfurreducens | Q746Y3 | P35558 |
| 530 | GDADVMVAGG | Escherichia coli, Escherichia coli, Escherichia coli | P0AAI5, P0AAI6, P0AAI7 | Q9NUVU1 |
| 531 | GDADVMVAGGT | Rhizobium meliloti | P56902 | Q9NUVU1 |
| 532 | GDDEAMFID | Parabacteroides distasonis | A6L8C6 | Q15046 |
| 533 | GDGAANQGQ | Rhizobium meliloti | Q9R9N5 | P08559 |
| 534 | GDGAFYGPKID | Bacillus subtilis, ptoclostridium difficile, Clostridium thermocellum, Clostridium tetani, Clostridium botulinum, Clostridium botulinum, Clostridium botulinum, Clostridium botulinum, Clostridium botulinum, Clostridium botulinum, Clostridium kluyveri, Clostridium kluyveri, Clostridium novyi, Desulfovibrio desulfuricans, Desulfovibrio alaskensis, Desulfovibrio vulgaris, Desulfovibrio vulgaris | P18256, Q18968, A3DET1, Q891T0, B1IMV3, B1L0T7, C3KTK0, A5I6L8, A7FY87, C1FKN0, A7GI05, A5N258, B9E5W0, A0PZN1, B8J4E4, Q30Y11, A1VBB4, Q728R5 | A2RTX5 |
| 535 | GDGAFYGPKIDI | Desulfovibrio salexigens | C6BRH1 | A2RTX5 |
| 536 | GDGAFYGPKIDIK | Desulfovibrio maeticus, Desulfovibrio vulgaris, Geobacter bemidjiensis, Geobacter sp., Geobacter sulfurreducens | C4XL11, B8DPN2, B5EBX9, C6DYJ5, Q74D04 | A2RTX5 |
| 537 | GDGIARVHG | Desulfovibrio vulgaris, Desulfovibrio vulgaris | Q72E02, A1VFJ3 | P25705 |
| 538 | GDGIARVHGL | Bacillus pumilus, Bacillus licheniformis, Bacillus methylotrophicus, Bacillus subtilis, Desulfitobacterium hafniense, Desulfitobacterium hafniense | A8FIB4, Q65DX2, A7Z9Q2, P37808, B8FZ36, Q24MN9 | P25705 |
| 539 | GDGIGPEIS | Bacteroides thetaiotaomicron, Bacteroides fragilis, Bacteroides fragilis | Q8A6M0, P54354, Q5LAB4 | P50213 |
| 540 | GDGVNDAPAL | Bacillus pseudofirmus, Listeria monocytogenes, Rhizobium leguminosarum, Staphylococcus saprophyticus, Staphylococcus aureus, Staphylococcus aureus, Staphylococcus aureus | P30336, P58414, Q9X5V3, Q4A0G1, P20021, Q6GIX1, P37386 | Q14983 |
| 541 | GDIIIDGGN | Citrobacter amalonaticus, Citrobacter koseri, Citrobacter freundii, Escherichia coli, Escherichia coli, Escherichia vulneris, Klebsiella pneumoniae, Raoultella terrigena, Raoultella planticola | P41581, P41582, P41583, P00350, P37754, P41574, P41576, P41577, P41575 | P52209 |
| 542 | GDMDFKIAGT | Desulfovibrio alaskensis, Desulfovibrio desulfuricans | Q30WI5, B8J1X9 | Q8TCS8 |
| 543 | GDRVAIYMP | Streptomyces coelicolor | Q9X928 | Q9NUB1 |
| 544 | GDRVAVMLP | Bacillus subtilis | P94547 | Q68CK6 |
| 545 | GDVLVLTKPLGT | Eubacterium acidaminophilum | Q9L473 | P49903 |
| 546 | GDWKGYTGK | Haemophilus ducreyi | Q7VNR9 | P06744 |
| 547 | GEEQVKIWRRS | Clostridium phytofermentans | A9KNQ1 | P15259 |
| 548 | GEERCIACKLCEA | Neisseria meningitidis, Neisseria meningitidis, Neisseria gonorrhoeae, Neisseria meningitidis, Ralstonia solanacearum | Q7DDS1, A1KRT1, Q5F623, Q9JQM2, Q8XXQ9 | O00217 |
| 549 | GEIVSADSMQ | Leuconostoc mesenteroides | Q03VI2 | Q9H3H1 |
| 550 | GENGAGKST | Clostridium tetani | Q89712 | Q9NUQ8 |
| 551 | GEPVSAEDL | Proteus mirabilis | B4ET09 | P11586 |
| 552 | GERAYDIYSRLL | Lactobacillus salivarius, Haemophilus parasuis | Q1WTA8, B8F822 | Q16740 |
| 553 | GEVMAIGRT | Bacillus subtilis, Lactobacillus helveticus, Lactobacillus delbrueckii, Lactobacillus acidophilus, | P25994, A8YVZ3, Q047M8, Q5FJC0, Q74J34, B2GD06, | P31327 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Lactobacillus johnsonii, Lactobacillus fermentum, Lactobacillus casei, Lactobacillus casei, Lactobacillus reuteri, Lactobacillus reuteri, Fusobacterium nucleatum, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus aureus, Staphylococcus aureus, Staphylococcus aureus, Staphylococcus saprophyticus, Streptococcus uberis* | Q038Z2, B3WEF5, B2G564, A5VHN6, Q8RG86, Q4L5Q5, P63739, P63740, A6U122, A7X1F4, A5Is88, Q2FHN5, A8Z3P0, Q5HGM9, A6QGA4, Q2FZ72, Q6GA10, Q5HPY8, Q8CPJ4, Q6GHN2, Q2YXG5, P58940, Q49WY4, B9DRV7 | |
| 554 | GEVMAIGRTFEES | *Bacillus caldolyticus* | P46537 | P31327 |
| 555 | GEVTEINEA | *Methylobacterium nodulans* | B8IU03 | P23434 |
| 556 | GFCHGVLNTDNMS | *Aeromonas salmonicida* | A4SHK8 | Q9BVL4 |
| 557 | GFILDGFPR | *Lactobacillus johnsonii, Lactobacillus gasseri, Lactobacillus delbrueckii, Geobacter bemidjiensis, Geobacter sp.* | Q74L69, Q046A5, Q04BZ4, B5EFS1, C6E4N6 | Q5TCS8 |
| 558 | GFLLDGFPRTV | *Bacillus methylotrophicus, Bacillus subtilis* | A7Z0Q9, P16304 | P54819 |
| 559 | GFPGETDQDF | *Haemophilus somnus, Rhizobium meliloti* | Q0I3Z1, Q92SI7 | Q5W42 |
| 560 | GFPSVGKST | *Lactobacillus delbrueckii, Lactobacillus delbrueckii, Pediococcus ntosaceus* | Q04611, Q1GAM3, Q03F34 | P55039 |
| 561 | GFPSVGKSTLLS | *Lactobacillus reuteri, Lactobacillus reuteri, Lactobacillus fermentum* | B2G6R9, A5VJ99, B2GBD0 | Q9Y295 |
| 562 | GFRGEALASI | *Lactobacillus delbrueckii, Lactobacillus delbrueckii, Lactobacillus johnsonii, Lactobacillus casei, Lactobacillus casei, Lactobacillus gasseri, Ralstonia solanacearum, Uncultured termite* | Q1G939, Q048Y5, Q74KW0, Q035Z3, B3W9W3, Q045Q4, Q8XWB1, B1H0C7 | P40692 |
| 563 | GFRGEALASIS | *Aeromonas hydrophila, Aeromonas salmonicida, Lactobacillus acidophilus, Lactobacillus helveticus, Citrobacter koseri, Clostridium botulinum, Clostridium botulinum, Clostridium botulinum, Clostridium botulinum, Clostridium botulinum, Clostridium botulinum, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Haemophilus influenzae, Haemophilus influenzae, Haemophilus influenzae, Haemophilus influenzae, Haemophilus ducreyi, Haemophilus somnus, Klebsiella pneumoniae, Klebsiella pneumoniae, Proteus* | A0KGR9, A45R27, Q5FLX4, A8YTI0, A8AMN1, C3KX34, B1IM67, A7FUK9, A7GE44, B1KSA2, C1FNT8, C5BDM9, A4W5R1, A1AJ76, Q0T9M3, B7MKX4, P23367, B1XDS1, C5A1G1, B6I274, A8A7R4, B7UQH9, A7ZV39, B7M8T0, Q8XDN4, B1LQJ0, B5Z2H6, B7MSY3, Q8FAK9, B1IT36, B7LLV2, B7LC24, B7NGA4, A5UB71, A5UFN4, Q4QPH7, P44494, Q7VN43, Q0I463, B5Y334, A6TH85, B4F203, A4VQP2, B0KKZ7, C3KDW1, Q1I447, B1JAD6, B7V209, Q9HUL8, Q02F72, | P40692 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | mirabilis, Pseudomonas stutzeri, Pseudomonas putida, Pseudomonas fluorescens, Pseudomonas entomophila, Pseudomonas putida, Pseudomonas aeruginosa, Pseudomonas aeruginosa, Pseudomonas aeruginosa, Pseudomonas putida, Pseudomonas syringae, Pseudomonas aeruginosa, Staphylococcus carnosus, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q88DD1, Q87VJ2, A6VD59, B9DPC0, Q49X89, Q6GHD9, P65492, P65491, A7X1T8, A6U1B5, Q8NWX9, Q6G9R7, A8Z1W7, Q5HGD5, A6QGJ5, Q93T05, Q2FHE2, Q8CPE9, Q5HPP4 | |
| 564 | GFRGEALSS | Eubacterium rectale | C4ZA52 | P54278 |
| 565 | GFVMGEGAAVLVLE | Streptomyces coelicolor | P23155 | Q9NWU1 |
| 566 | GFYSAFMVA | Bacteroides thetaiotaomicron | Q8A9B8 | Q12931 |
| 567 | GGADRIELCS | Rhizobium meliloti | Q925Z1 | Q9NTM9 |
| 568 | GGAGVQHIAL | Streptomyces avermitilis, Streptomyces coelicolor | Q53586, Q9S2F4 | P32754 |
| 569 | GGAGYIGSH | Lactobacillus helveticus, Streptococcus mutans, Streptococcus thermophilus | Q7WTB1, P96995, P21977 | Q14376 |
| 570 | GGAGYIGSHT | Rhizobium leguminosarum, Rhizobium meliloti | Q59745, P26503 | Q14376 |
| 571 | GGAGYIGSHTV | Lactobacillus casei | O84903 | Q14376 |
| 572 | GGAIALGHP | Bacillus subtilis, Clostridium acetobutylicum, Escherichia coli, Pseudomonas aeruginosa, Pseudomonas fragi, Pseudomonas syringae, Pseudomonas fluorescens, Pseudomonas syringae, Pseudomonas fluorescens, Pseudomonas savastanoi, Pseudomonas aeruginosa, Pseudomonas aeruginosa, Pseudomonas aeruginosa, Pseudomonas putida, Pseudomonas oleovorans, Pseudomonas putida, Pseudomonas putida, Pseudomonas entomophila, Pseudomonas mendocina, Pseudomonas stutzeri | P45855, P45359, Q46939, Q9I2A8, P28790, Q87ZB3, Q3K9D9, Q4ZRA1, Q4KFC3, Q48GW4, Q02PH7, A6V383, Q9HZJ3, A5W6G9, Q93Q11, Q9R9W0, Q88L01, Q1I7D5, A4XSM9, A4VKA4 | Q9BWD1 |
| 573 | GGAIALGHPLG | Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas hydrophila, Aeromonas salmonicida, Bacillus subtilis, Citrobacter koseri, Enterobacter sp., Enterobacter cloacae, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Klebsiella pneumoniae, | A3M1H9, B7I3P0, B0VLX5, B0VE46, B7H1I1, B2I2J8, Q6FF69, A0KEL0, A4STF3, O32177, A8ACZ3, A4WFX5, Q9F0Y6, P0C7L3, P0C7L2, B7LTZ0, Q8X8J4, A1A132, A8A6V0, A7ZU50, Q1R467, Q8FBI3, P21151, Q0TAL1, A6TGM3, Q9I6R0, Q51956 | Q9BWD1 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 574 | GGAIALGHPLGASG | *Pseudomonas aeruginosa, Pseudomonas putida, Pseudomonas knackmussii* | Q8VPF1 | Q9BWD1 |
| 575 | GGARGQATDI | *Clostridium thermocellum, Clostridium cellulolyticum* | A3DJ10, B8I8F5 | Q16740 |
| 576 | GGDGTLLYA | *Bacillus licheniformis, Bacillus cereus, Bacillus thuringiensis, Bacillus cereus, Bacillus anthracis, Bacillus cereus, Bacillus subtilis* | Q65LA2, Q81GJ9, Q6HLY2, Q63EG5, Q81TQ3, Q73BU7, O31612 | O95544 |
| 577 | GGENIYPAE | *Bacillus licheniformis, Bacillus pumilus, Bacillus subtilis, Bacillus methylotrophicus* | Q65FT5, A8FGK6, P23971, A7Z809 | Q96CM8 |
| 578 | GGFGLCGIPE | *Bacillus subtilis* | P42315 | P55809 |
| 579 | GGGCSGFQY | *Aeromonas salmonicida, Aeromonas hydrophila, Citrobacter koseri, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus somnus, Haemophilus influenzae, Haemophilus influenzae, Haemophilus influenzae, Haemophilus influenzae, Haemophilus ducreyi, Haemophilus parasuis, Klebsiella pneumoniae, Klebsiella pneumoniae, Neisseria meningitidis, Neisseria meningitidis, Neisseria meningitidis, Neisseria gonorrhoeae, Proteus mirabilis, Pseudomonas putida, Pseudomonas fluorescens, Pseudomonas entomophila, Pseudomonas syringae, Pseudomonas syringae, Pseudomonas savastanoi, Pseudomonas fluorescens, Pseudomonas fluorescens, Pseudomonas mendocina, Pseudomonas stutzeri, Pseudomonas aeruginosa, Pseudomonas aeruginosa, Pseudomonas aeruginosa, Pseudomonas aeruginosa, Ralstonia pickettii, Ralstonia solanacearum* | A4SJ82, A0KNY6, A8ALD2, C5BAP7, A4W6Q3, B7LWB7, Q1RG32, B1LGV9, B6HZD2, B7N825, P0ACC3, B1IQI4, P0ACC4, A1A7K2, A7ZWA4, Q0TLH5, B1XD26, B7M197, C4ZRP9, B7NIB9, B7MP18, B5Z0D6, P0ACC5, B7MBD9, B7LGL8, B7UIK3, A7ZHP8, Q0I3N9, P45344, A5UBF7, A5UFF5, Q4QJM4, Q9X4A0, B8F870, A6T4W0, B5Y1L3, Q7DDN1, A1KSG6, A1IQG0, Q5F6W8, B4EUE2, Q88QQ5, Q4K514, Q1IFY7, Q4ZMM4, Q889Z2, Q48NN6, Q3K5W6, C3K2Z6, A4XZB1, A4VHK9, B7V623, Q02TA1, Q9I5Q6, A6UZG6, B2UFK5, Q8Y242 | Q86U28 |
| 580 | GGGSIRIHNA | *Staphylococcus carnosus* | B9DNF8 | Q6PI48 |
| 581 | GGIDILVNNAS | *Rhizobium loti* | Q988B7 | Q6YN16 |
| 582 | GGILDDLIV | *Streptomyces coelicolor, Streptomyces avermitilis* | O86567, Q82JI2 | P48728 |
| 583 | GGKPANFLD | *Campylobacter fetus, Haemophilus influenzae, Haemophilus influenzae, Haemophilus influenzae, Haemophilus influenzae, Pseudomonas fluorescens, Pseudomonas syringae, Pseudomonas syringae, Pseudomonas savastanoi, Pseudomonas fluorescens, Pseudomonas fluorescens, Pseudomonas aeruginosa, Pseudomonas aeruginosa, Pseudomonas aeruginosa, Pseudomonas aeruginosa, Pseudomonas putida, Pseudomonas* | A0RPE8, A5UCR4, P45101, A5UIW0, Q4QLA3, Q4KFY6, Q883Z4, Q4ZUW7, Q48K68, Q3KFU6, C3K6N0, P53593, B7UVD3, A6V7K5, Q02K73, B1JAV3, Q1I7L3, Q88FB2, A5W114, B0KNW8 | Q96I99 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *entomophila, Pseudomonas putida, Pseudomonas putida, Pseudomonas putida* | | |
| 584 | GGLRTALYNY | *Campylobacter curvus, Campylobacter concisus* | A7H0G1, A7ZFB9 | Q5JPH6 |
| 585 | GGLYPVSAVL | *Staphylococcus aureus, Staphylococcus aureus, Staphylococcus aureus, Staphylococcus aureus, Staphylococcus aureus, Staphylococcus aureus* | Q6GCU1, Q5HJI8, Q8NYM5, P60296, P60295, Q6GKC1 | P04181 |
| 586 | GGNGWLLDG | *Desulfovibrio maeticus* | C4XPE9 | Q9HC57 |
| 587 | GGPPCQGFS | *Haemophilus parahaemolyticus* | P50192 | P26358 |
| 588 | GGREHTLAWK | *Bacillus subtilis* | P12039 | P22102 |
| 589 | GGRYDGLVG | *Acinetobacter baumannii, Acinetobacter baumannii* | A3M212, B2I3E6 | P12081 |
| 590 | GGSAVDAAI | *Bacillus anthracis* | Q51693 | A6NGU5 |
| 591 | GGSDLGPLMV | *Acinetobacter baylyi* | Q59088 | P06744 |
| 592 | GGSDLGPLMVT | *Acinetobacter lwoffii* | Q9RMC1 | P06744 |
| 593 | GGSDNHLIL | *Helicobacter hepaticus* | Q7VFL1 | P34896 |
| 594 | GGSNGGLLV | *Aeromonas hydrophila* | Q06903 | P48147 |
| 595 | GGSPTPFDRN | *Bacteroides thetaiotaomicron* | Q8A2E9 | P08237 |
| 596 | GGSRGIGRA | *Escherichia coli* | P52037 | Q8N4T8 |
| 597 | GGTCVNVGCVP | *Acinetobacter calcoaceticus, Bacillus cereus, Enterobacter agglomerans, Pseudomonas aeruginosa, Streptomyces lividans* | Q52109, P16171, P94702, P00392, P30341 | P00390 |
| 598 | GGTCVNVGCVPKVMW | *Streptococcus thermophilus* | Q60151 | P00390 |
| 599 | GGTFTISNGGVFGSL | *Pseudomonas aeruginosa* | Q9I3D2 | P36957 |
| 600 | GGTVGDIES | *Aeromonas hydrophila, Aeromonas salmonicida, Bacillus halodurans, Lactobacillus salivarius, Bacillus licheniformis, Bacillus subtilis, Bacillus cytotoxicus, Bacillus clausii, Lactobacillus plantarum, Lactobacillus brevis, Bacillus thuringiensis, Bacillus cereus, Bacillus thuringiensis, Bacillus cereus, Bacillus cereus, Bacillus cereus, Bacillus cereus, Bacillus anthracis, Bacillus anthracis, Bacillus anthracis, Bacillus cereus, Bacillus cereus, Bacillus cereus, Bacillus cereus, Bacillus weihenstephanensis, Bacillus methylotrophicus, Bacillus pumilus, Lactobacillus sakei, Lactobacillus johnsonii, Lactobacillus acidophilus, Desulfitobacterium hafniense, Bifidobacterium longum, Bacteroides fragilis, Bacteroides fragilis, Citrobacter koseri, Clostridium thermocellum, Clostridium beijerinckii, Clostridium acetobutylicum, Corynebacterium jeikeium, Corynebacterium kropnstedtii, Edwardsiella ictaluri, Enterobacter sp., Enterococcus faecalis, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter sulfurreducens, Geobacter metallireducens, Geobacter daltonii,* | A0KGH2, A4SRC2, Q9K6D7, Q1WV30, Q65DT7, P13242, A7GV88, Q5W343, Q88Z76, Q03T27, Q6HAU5, C1F0R6, A0RLC3, B7IQZ1, Q630R0, B7JHG1, Q814T2, C3P2A0, C3LFL2, Q81JW1, Q72XB0, B7HY98, B9IRX1, B7HFN6, A9VSD6, A7Z9T4, A8FIE5, Q38V48, Q74LG2, Q5FME6, Q24MK9, Q8G5X7, Q5LC42, Q64T27, A8ANY8, A3DGR3, A6LQF6, Q97F61, Q4JVX2, C4LIF4, C5B8X3, A4WDW8, Q836G5, B7UHJ6, Q1R7R3, B1LQB3, B7LWP4, B7LXJ6, B7N716, B1XDJ0, B6I6H6, P0A7E7, P0A7E5, B1IU61, P0A7E6, A8A3R5, B7MLA1, B5Z3E4, Q0TE79, C4ZZT3, B7NV70, A1AEW8, B7MZ76, B7LEK0, A7ZQM3, Q74BY3, Q39W62, B9M9Q5, A5G5T3, B3EAK5, A5UD28, A5UIK2, Q4QLL2, P44341, Q7VNV5, Q0I200, B8F5Q9, A6TD54, B5XV18, Q927T4, Q71WM0, Q8Y495, | P17812 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Geobacter uraniireducens, Geobacter lovleyi, Haemophilus influenzae, Haemophilus influenzae, Haemophilus influenzae, Haemophilus influenzae, Haemophilus ducreyi, Haemophilus somnus, Haemophilus parasuis, Klebsiella pneumoniae, Klebsiella pneumoniae, Listeria innocua, Listeria monocytogenes, Listeria monocytogenes, Neisseria meningitidis, Neisseria meningitidis, Neisseria gonorrhoeae, Neisseria gonorrhoeae, Neisseria meningitidis, Neisseria meningitidis, Propionibacterium acnes, Proteus mirabilis, Pseudomonas fluorescens, Pseudomonas fluorescens, Pseudomonas putida, Pseudomonas fluorescens, Pseudomonas putida, Pseudomonas putida, Pseudomonas entomophila, Pseudomonas putida, Pseudomonas syringae, Pseudomonas savastanoi, Pseudomonas syringae, Pseudomonas aeruginosa, Pseudomonas aeruginosa, Pseudomonas aeruginosa, Pseudomonas aeruginosa, Pseudomonas mendocina, Pseudomonas stutzeri, Ralstonia solanacearum, Ralstonia pickettii, Sphingomonas wittichii, Streptococcus equi, Streptococcus equi, Streptococcus thermophilus, Streptococcus thermophilus, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus mutans, Streptococcus pneumoniae, Streptococcus pyogenes, Streptococcus pneumoniae, Streptococcus sanguinis, Streptococcus gordonii, Streptococcus agalactiae, Streptococcus agalactiae, Streptococcus agalactiae | A1KUX8, Q9JTK1, B4RJ40, Q5F7G6, Q9JYJ8, A9M0Y3, Q6A7X4, B4EUF6, C3K6H4, Q4KHF8, B1JBP2, Q3KH94, A5W831, Q88MG1, Q1I644, B0KSB7, Q4ZWR0, Q48F77, Q886M5, B7V7V1, Q9HXZ4, A6V1F1, Q02RA9, A4XWS3, A4VJT9, Q8Y0B8, B2U9C0, A5V8U1, C0M8K6, C0MFQ9, Q5M6C03 Q5M1S7, Q8NZF8, Q1J4X1, Q1JF16, Q1J9X6, P0DD70, Q1JK23, Q5XA10, P0DD71, P65925, Q8DWG1, Q97S93, Q48RF1, Q8DQY0, A3CQB0, A8AZ08, Q8E290, Q8E7P8, Q3K3S2 | |
| 601 | GHGALAEKA | Clostridium novyi | A0Q0Q1 | Q8TCS8 |
| 602 | GHGALAEKAL | Clostridium acetobutylicum, Clostridium tetani, Clostridium kluyveri, Clostridium kluyveri, Desulfovibrio vulgaris, Desulfovibrio vulgaris, Desulfovibrio vulgaris | Q97I45, Q895J3, A5N848, B9E1K8, B8DN07, A1VG88, Q72ER6 | Q8TCS8 |
| 603 | GHIAFNEPG | Lactobacillus delbrueckii, Lactobacillus delbrueckii, Lactobacillus helveticus, Lactobacillus johnsonii, Lactobacillus acidophilus | Q04713, Q1G817, A8YTN8, Q74HC4, Q5FHT1 | P46926 |
| 604 | GHLRSTIIG | Bacillus halodurans | Q9KEL8 | P54136 |
| 605 | GHNGAGKST | Aeromonas salmon icida | Q07698 | O94911 |
| 606 | GHNGAGKTT | Pseudomonas stutzeri | P19844 | Q8IZY2 |
| 607 | GHPEVYILILP | Escherichia coli, Escherichia coli, Escherichia coli, Pseudomonas aeruginosa, Pseudomonas putida | P0ABI8, P0ABI9, P0ABJ0, Q91426, Q9WWR2 | P00395 |
| 608 | GHPSFVMSNSF | Streptomyces fradiae | P26799 | P23526 |
| 609 | GHSGAGKST | Pseudomonas entomophila, Pseudomonas putida | Q1IGZ0, Q88RL5 | O94911 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 610 | GHSGAGKSTLL | Clostridium acetobutylicum, ptoclostridium difficile, Pseudomonas fluorescens, Pseudomonas aeruginosa, Pseudomonas aeruginosa | Q97KD5, Q18C09, Q4KKK8, Q9HT70, Q02DK6 | O94911 |
| 611 | GHSMGGKTAM | Haemophilus influenzae | Q57427 | Q8NFV4 |
| 612 | GICGSDVHY | Escherichia coli | P77360 | Q00796 |
| 613 | GICLGHQLL | Desulfovibrio maeticus | C4XRH8 | P27708 |
| 614 | GIDLGTTNS | Helicobacter acinonychis, Helicobacter hepaticus | Q17VY4, Q7VIE3 | P38646 |
| 615 | GIDLGTTNSCV | Campylobacter concisus, Campylobacter curvus, Desulfovibrio salexigens, Pseudomonas fluorescens, Pseudomonas savastanoi | A7ZEB5, A7GXU4, C6BSF2, C3K275, Q9WWG9 | P38646 |
| 616 | GIDLGTTNSCVAVM | Haemophilus parasuis, Haemophilus influenzae, Haemophilus influenzae, Haemophilus influenzae, Haemophilus influenzae | B8F7S6, A5UF68, P43736, Q4QJW4, A5UBQ1 | P38646 |
| 617 | GIGGSDLGP | Propionibacterium acnes, Stenotrophomonas maltophilia, Stenotrophomonas maltophilia, Streptomyces avermitilis | Q6A5X5, B4SRY7, B2FL71, Q829V7 | P06744 |
| 618 | GIGPVPAIS | Staphylococcus aureus, Staphylococcus aureus, Staphylococcus aureus, Staphylococcus aureus, Staphylococcus aureus, Staphylococcus aureus | Q7A768, Q7A1P9, Q7A2W9, Q9KWK4, Q6GJ93, Q6GBR1, Q5HIA0 | P42765 |
| 619 | GIIDLKELEAA | Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Klebsiella pneumoniae, Klebsiella pneumoniae | A4WDB1, B6I5A2, P0A6B8, B1LNI6, B7N6B7, B1IWD1, P0A6B7, B1X1305, C4ZXA5, Q0TEV5, A8A336, B7MYG3, B7M7N3, B7NRH9, B5Z104, P0A6B9, B7LDC2, B7MIM0, A7ZPX4, B7UGX6, B7LKA9, B5XNJ7, A6TCF1 | Q9Y697 |
| 620 | GIIVSNHGGRQLD | Pseudomonas mendocina | A4XYG7 | Q9NYQ3 |
| 621 | GILLYGPPG | Bacillus subtilis | O34703 | P46459 |
| 622 | GILVQLPLP | Bacillus cytotoxicus, Bacillus cereus, Bacillus thuringiensis, Bacillus cereus, Bacillus thuringiensis, Bacillus cereus, Bacillus cereus, Bacillus cereus, Bacillus cereus, Bacillus cereus, Bacillus cereus, Bacillus cereus, Bacillus weihenstephanensis, Bacillus anthracis, Bacillus anthracis, Bacillus anthracis, Enterococcus faecalis, Pseudomonas putida | A7GSJ9, Q635A3, A0RIH3, C1ERQ4, Q6HDY4, B7JM32, B7HNU4, B9IXH4, B7IXH2, Q73162, B7HB52, Q818R5, A9VGW3, C3LJV5, Q81M50, C3P7W0, Q836W7, B0KLM9 | Q9H903 |
| 623 | GILVQLPLPDH | Campylobacter jejuni | A7H3N3 | Q9H903 |
| 624 | GIMAHIDAGKTTTTERIL | Clostridium botulinum | B2UYA7 | Q969S9 |
| 625 | GIMAHIDAGKTTTTERILYY | Methylobacterium sp. | B0UHX2 | Q969S9 |
| 626 | GINGFGRIGR | Bacillus megaterium, Bacillus cereus, Haemophilus influenzae, Ralstonia solanacearum, Streptomyces arenae, Streptomyces arenae | P23722, Q4MQ58, P44304, P52694, E3VWI2, P54226 | O14556 |
| 627 | GINGFGRIGRL | Lactobacillus delbrueckii | O32755 | O14556 |
| 628 | GINGTVGGS | Corynebacterium jeikeium, Corynebacterium urealyticum | Q4JXR5, B1VHR9 | Q5T7W7 |
| 629 | GIPFYVAAP | Bacillus weihenstephanensis, Bacillus cereus, Desulfovibrio salexigens | A9VFD5, Q731R7, C6C0F7 | Q9BV20 |
| 630 | GIPIAVKDN | Akkermansia muciniphila | B2UMP4 | Q9H0R6 |
| 631 | GISGAIQHLAGM | Bacillus subtilis, Clostridium acetobutylicum | P94551, P52039 | P13804 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 632 | GIVGLPNVGKST | Bacillus subtilis, Escherichia coli, Escherichia coli, Haemophilus influenzae, Haemophilus ducreyi | P37518, P0ABU2, P0ABU3, P44681, Q7VMI2 | Q9NTK5 |
| 633 | GIVHRDIKP | Streptomyces coelicolor | Q9XA16 | Q14164 |
| 634 | GKAGRNRWLG | Desulfovibrio desulfuricans, Desulfovibrio salexigens, Desulfovibrio vulgaris | B8IYH5, C6C188, B8DN99 | Q5T653 |
| 635 | GKAGRNRWLGKRP | Methylobacterium extorquens, Methylobacterium extorquens | B7L0R4, A9W4Q4 | Q5T653 |
| 636 | GKGFQGVMKRW | Desulfovibrio salexigens | C6C185 | P09001 |
| 637 | GKGRPGWHIECS | Staphylococcus carnosus, Staphylococcus epidermidis, Staphylococcus epidermidis | B9DKW3, Q5HRM3, Q8CTU1 | P49589 |
| 638 | GKKVAIIGAG | Escherichia coli | P09832 | P31513 |
| 639 | GKLHTGRSRNDQV | Bacillus methylotrophicus, Bacillus subtilis, Bacillus cytotoxicus, Bacillus weihenstephanensis, Bacillus cereus, Bacillus thuringiensis, Bacillus anthracis, Bacillus anthracis, Bacillus anthracis, Bacillus halodurans, Bacillus cereus, Bacillus cereus, Bacillus cereus, Bacillus cereus, Bacillus cereus, Bacillus cereus, Bacillus thuringiensis, Bacillus clausii, Desulfovibrio salexigens, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus carnosus, Staphylococcus haemolyticus | A7Z7L9, O34858, A7GTR4, A9VKE0, B7IK28, Q6HCP8, C3L913, Q81KV8, C3PB96, Q9K821, Q633G5, Q817C7, B7HRS6, Q72ZA4, B7H6Y4, B7JS05, A0RJM3, Q5WED9, C6BTR8, Q6GIC8, P63582, P63583, A6QFH1, Q5HHC5, A5IRD8, A6U067, Q2FZU2, A7X0H4, Q8NXF3, Q6GAW6, Q2YWS5, A8Z066, Q2FIB5, Q8CT81, Q5HQK1, B9DIU3, Q4L4X6 | P04424 |
| 640 | GKLNDHFPLVVWQTGSGTQ | Rhizobium loti | Q983U5 | P07954 |
| 641 | GKLTARERI | Bacillus subtilis | P54541 | P05166 |
| 642 | GKPDPDIFL | Bacillus subtilis | O06995 | Q08623 |
| 643 | GKRVDFSGR | Campylobacter fetus, Campylobacter lari, Campylobacter jejuni, Campylobacter jejuni, Campylobacter jejuni, Campylobacter jejuni, Helicobacter pylori, Helicobacter acinonychis, Helicobacter pylori, Helicobacter pylori, Helicobacter pylori | A0RQI4, B9KFG8, A8FKR4, A1VYJ5, Q5HVY8, Q9PI30, B2UUV9, Q17VN6, Q25806, Q1CS68, Q9ZK23 | O14802 |
| 644 | GKSTLINTL | Helicobacter hepaticus | Q7VGJ2 | Q9UHD8 |
| 645 | GKSTLLNIL | Pseudomonas aeruginosa, Pseudomonas aeruginosa, Staphylococcus haemolyticus | Q9HX79, Q02SA6, Q4L8L7 | Q94911 |
| 646 | GKSTLMNIL | Acinetobacter baylyi, Campylobacter fetus, Escherichia coli, Escherichia coli, Escherichia coli, Escherichia coli, Escherichia coli, Neisseria gonorrhoeae, Neisseria gonorrhoeae, Neisseria meningitidis, Neisseria meningitidis, Pseudomonas aeruginosa, Pseudomonas aeruginosa, Pseudomonas entomophila, Pseudomonas fluorescens, Pseudomonas fluorescens, Pseudomonas syringae, Pseudomonas putida, Pseudomonas | Q6F813, A0RP01, Q0TJH0, Q1RE44, A1A9B7, P75831, Q8XED0, Q5MK06, Q5F6V6, Q9K0N7, Q9JVR5, Q9I190, Q02MI4, Q1I966, Q3KE48, Q4KES7, Q881Q1, Q88F88, Q1I7I9, Q4K9A4, Q92NU9 | P45844 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | entomophila, Pseudomonas fluorescens, Rhizobium meliloti | | |
| 647 | GKSTLVNTL | Rhizobium loti | Q98JM4 | Q9UH03 |
| 648 | GKTALMMAA | Pseudomonas aeruginosa | Q9HYV6 | Q8N8A2 |
| 649 | GKTLAYLLP | Bacillus cereus | Q81E85 | Q92841 |
| 650 | GKTLLAQTLA | Rhizobium loti | Q982V5 | O76031 |
| 651 | GKTNLDEFA | Bifidobacterium longum, Bifidobacterium longum, Bifidobacterium longum | Q8G768, B3DU32, B7GTU6 | Q9H0R6 |
| 652 | GKTNLDEFAMG | Lactobacillus brevis, Clostridium cellulolyticum | Q03Q16, B8I601 | Q9H0R6 |
| 653 | GKTNLDEFAMGS | Lactobacillus sakei, Lactobacillus reuteri, Lactobacillus reuteri, Propionibacterium acnes, Desulfovibrio desulfuricans | Q38VC9, B2G8T6, A5VLG3, Q6A8P5, B8J405 | Q9H0R6 |
| 654 | GKTSIARSIA | Clostridium phytofermentans | A9KH99 | P36776 |
| 655 | GKVADYIPQLA | Rhizobium sp., Rhizobium meliloti | C3MD81, Q92PH0 | O94925 |
| 656 | GKWMDGWETRR | Ralstonia pickettii, Ralstonia solanacearum, Rhizobium meliloti | B2UG65, Q8XUB7, Q92VC1 | Q8N6M5 |
| 657 | GKWMDGWETRRKR | Acinetobacter baumannii, Acinetobacter baumannii, Acinetobacter baumannii, Acinetobacter baumannii, Acinetobacter baumannii, Acinetobacter baylyi, Pseudomonas aeruginosa, Pseudomonas aeruginosa, Pseudomonas aeruginosa | A3MA02, B0VP26, B0V9T8, B7GV54, B7ICG5, Q6F6Y1, A6V7Y9, Q02JZ8, B7UW33, Q9I3J8 | Q8N6M5 |
| 658 | GLAAGKGVI | Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q6GI10, Q6GAD9, Q5HH10, Q8NX87, P65895, P65896, Q5HQ96, Q8CT26 | P22102 |
| 659 | GLAARDSLRLEAG | Corynebacterium aurimucosum | C3PHK3 | P48728 |
| 660 | GLFDLKAAGF | Methylobacterium sp., Rhizobium meliloti, Rhizobium sp., Rhizobium loti, Rhizobium leguminosarum, Rhizobium etli, Rhizobium leguminosarum, Rhizobium etli | B0UKC4, Q92QW2, C3M9F7, Q984K6, Q1MIW9, B3PV93, B5ZX12, Q2KA45 | P22102 |
| 661 | GLFDLKAAGFKDP | Methylobacterium nodulans | B8IP71 | P22102 |
| 662 | GLIIGKGGA | Clostridium thermocellum | A3DJH8 | P51513 |
| 663 | GLLGPNGAGK | Escherichia coli, Escherichia coli, Escherichia coli, Ralstonia solanacearum, Rhizobium meliloti | P0A9V1, P0A9V2, P0A9V3, Q8XXY9, P25885 | Q8WWZ7 |
| 664 | GLLGPNGAGKST | Bacillus subtilis, Escherichia coli, Rhizobium sp. | P94440, P0A9U1, P55476 | Q8WWZ7 |
| 665 | GLLGPNGAGKSTI | Rhizobium etli, Rhizobium sp., Rhizobium loti, Rhizobium meliloti, Rhizobium leguminosarum, Rhizobium meliloti, Rhizobium leguminosarum, Rhizobium galegae | Q8KLG1, P72335, P23703, O52618, Q1M7W6, Q8GNH6, P08720, P50332 | Q8WWZ7 |
| 666 | GLNKNLGFS | Lactobacillus plantarum | Q88X60 | O43252 |
| 667 | GLNKNLGFSPEDR | Staphylococcus haemolyticus, Staphylococcus epidermidis, Staphylococcus epidermidis | Q4L9E6, Q8CR04, Q5HLO2 | O43252 |
| 668 | GLPNVGKST | Finegoldia magna | B0S3Z4 | Q9NTK5 |
| 669 | GLPSHPQHEL | Pseudomonas aeruginosa | P55218 | P32929 |
| 670 | GLQGSGKTTT | Helicobacter pylori, Helicobacter pylori | P56005, Q9ZK62 | P61011 |
| 671 | GLQVGDVIL | Pseudomonas putida, Pseudomonas putida, Pseudomonas putida, Pseudomonas fluorescens, Pseudomonas savastanoi, Pseudomonas fulva, Pseudomonas mendocina | B1J4D7, B0KV30, A5W8F5, Q4KGQ4, Q48EU9, F6AA62, A4XSC0 | Q86UT5 |
| 672 | GLSKLARIV | Clostridium thermocellum | A3DHH6 | P30793 |
| 673 | GLTAYFGLL | Bacillus subtilis | O34812 | Q14914 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 674 | GLTERFELFV | Neisseria meningitidis, Neisseria meningitidis, Neisseria meningitidis, Neisseria gonorrhoeae, Neisseria gonorrhoeae | A1KUN1, Q9JYU6, Q9JTT7, Q5F6U2, B4RP57 | Q15046 |
| 675 | GLTGGIASGKS | Bacillus licheniformis, Bacillus anthracis, Bacillus cereus, Bacillus thuringiensis, Bacillus subtilis, Bacillus cereus, Bacillus cereus, Bacillus clausii, Lactobacillus johnsonii, Fusobacterium nucleatum, Geobacter metallireducens, Geobacter sulfurreducens, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Streptococcus agalactiae, Streptococcus agalactiae, Streptococcus agalactiae, Streptococcus thermophilus, Streptococcus thermophilus | Q65G95, Q6HSG2, Q72ZF3, Q6HCU7, Q34932, Q817G7, Q633L3, Q5WEG9, Q74IB6, Q8RHR7, Q39R83, Q74FU2, Q6GG18, Q5HF85, Q6G8N8, P63832, P63831, Q2FG49, P63830, Q2YTA2, Q49Y69, Q3K029, Q8DYJ2, Q8E449, Q5M575, Q5M0N9 | Q8WVC6 |
| 676 | GLTGGIASGKSSV | Bacillus halodurans | Q9K857 | Q8WVC6 |
| 677 | GLVNNAGIST | Streptomyces exfoliatus | P19992 | Q02338 |
| 678 | GMGGAMDLV | Clostridium acetobutylicum, Escherichia coli, Haemophilus influenzae | P23673, P76459, P44874 | P55809 |
| 679 | GMGIPSISI | Lactobacillus sakei, Listeria welshimeri, Listeria innocua, Listeria monocytogenes, Listeria monocytogenes, Listeria monocytogenes, Streptococcus suis, Streptococcus suis | Q38X10, A0AJW1, Q92AF2, Q8Y644, B8DDP6, Q71YG0, C1KWF5, A4VWC2, A4W2M2 | Q16831 |
| 680 | GMNAAVRAV | Lactobacillus delbrueckii, Lactobacillus plantarum, Lactobacillus casei, Lactobacillus casei, Staphylococcus epidermidis, Staphylococcus epidermidis | P80019, Q88VY1, B3WE64, Q03910, Q8C568, Q5HNK6 | Q01813 |
| 681 | GMNAAVRAW | Streptococcus thermophilus, Streptococcus thermophilus | Q9L9E3, Q03KB7 | Q01813 |
| 682 | GMNAAVRAWR | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Streptococcus mutans | P65694, Q5HF75, A6QHN3, A8Z2L4, P65695, Q6G8M8, P99165, A5ITM2, Q2FXM8, A6U2G5, Q2YTE2, Q6GG08, Q8DTX6 | Q01813 |
| 683 | GMVITIEPGIY | Staphylococcus epidermidis, Staphylococcus epidermidis, Staphylococcus aureus, Staphylococcus aureus, Staphylococcus aureus, Staphylococcus aureus, Staphylococcus aureus, Staphylococcus haemolyticus, Staphylococcus aureus, Staphylococcus aureus, Staphylococcus aureus, Staphylococcus aureus | Q8CNW9, Q5HNJ7, Q6GFZ9, Q2FXL9, Q5HF67, Q2FG30, Q8NW55, Q4L749, Q99TF5, Q6G8L9, Q7A552, Q2YTD2 | Q9NQH7 |
| 684 | GMYSALAGF | Pseudomonas syringae, Pseudomonas savastanoi, Pseudomonas syringae | Q882A9, Q48IH8, Q4ZTN0 | Q86X67 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 685 | GNLCRCTGY | *Bacillus subtilis, Escherichia coli, Escherichia coli, Eubacterium barkeri, Pseudomonas* sp. | Q32143, Q46801, Q8X6C4, Q0QLF3, D7REY5 | Q06278 |
| 686 | GNLNAPTIM | *Stenotrophomonas maltophilia* | B2FQ89 | Q8NE62 |
| 687 | GNLNAPTIMIAEK | *Stenotrophomonas maltophilia* | B4SHV9 | Q8NE62 |
| 688 | GNNGGDGLV | *Lactobacillus buchneri* | F4FTW6 | Q8NCVV5 |
| 689 | GNPRPRVFRL | *Methylobacterium nodulans* | B8ID11 | Q02127 |
| 690 | GNPRPRVFRLP | *Methylobacterium extorquens* | B7KZJ5 | Q02127 |
| 691 | GNTGIGLAL | *Bacillus subtilis* | O05393 | P35520 |
| 692 | GNTVVIKPA | *Bacillus subtilis* | P42236 | O94788 |
| 693 | GNWDLVGNNTP | *Campylobacter jejuni, Haemophilus influenzae, Pseudomonas aeruginosa, Staphylococcus saprophyticus, Staphylococcus xylosus, Staphylococcus xylosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q59296, P44390, O52762, Q49XC1, Q9EV50, Q66V81, Q8NWV5, Q6G9M4, Q5HG86, Q7A5T2, Q2FH99, Q99UE2, Q2YXT2, Q2FYU7, Q9L451, Q6GH72, Q9L452 | P04040 |
| 694 | GPCGPCSEI | *Clostridium kluyveri, Streptomyces avermitilis* | A5N7T5, Q827S4 | P49588 |
| 695 | GPCGPCTEIH | *Clostridium botulinum, Clostridium beijerinckii, Clostridium botulinum* | B2THN0, A6LSF6, B2V3W2 | Q5JTZ9 |
| 696 | GPFANIAHG | *Bacillus pumilus, Bacillus cereus, Bacillus cereus, Bacillus cereus, Bacillus anthracis, Bacillus anthracis, Bacillus anthracis, Bacillus thuringiensis, Bacillus cereus, Bacillus cereus, Bacillus thuringiensis, Bacillus cereus, Bacillus cereus, Bacillus cereus, Lactobacillus casei, Lactobacillus casei, Lactobacillus acidophilus, Lactobacillus sakei, Lactobacillus salivarius, Lactobacillus reuteri, Lactobacillus reuteri, Lactobacillus plantarum, Lactobacillus fermentum, Lactobacillus brevis, Lactobacillus gasseri, Lactobacillus johnsonii, Lactobacillus acidophilus, Methylobacterium sp., Eubacterium rectale, Desulfitobacterium hafniense, Fusobacterium nucleatum, Methylobacterium populi, Methylobacterium radiotolerans, Eubacterium acidaminophilum, Methylobacterium nodulans, Methylobacterium extorquens, Methylobacterium extorquens, Methylobacterium extorquens, Parabacteroides distasonis, Bacteroides thetaiotaomicron, Bacteroides fragilis, Bacteroides fragilis, Bacteroides vulgatus, Campylobacter curvus, Campylobacter concisus, Clostridium thermocellum, Clostridium cylindrosporum, Clostridium tetani, Clostridium kluyveri, Clostridium kluyveri, Clostridium acidurici, Clostridium acetobutylicum, ptoclostridium difficile, Clostridium cellulolyticum, Clostridium phytofermentans, Corynebacterium jeikeium, Corynebacterium diphtheriae, Enterococcus faecalis,* | A8FEC9, B7HP29, B9IYP4, B7JLG8, Q81RE1, C3P858, C3LKJ6, Q6HJK9, Q63C61, C1ES77, A0RD97, Q739F4, B7IUA4, Q81E87, B3WEG3, Q038Y4, Q5FIU5, Q38X32, Q1WTW0, A5VHS9, B2G5A9, Q88W76, B2GF64, Q03S45, Q04310, Q74JC1, Q5FJY2, B0UQF5, C4ZBG8, Q24ZZ8, Q8RHF4, B1ZJ88, B1M0D1, Q5XZD9, B8IBS4, B7L0A5, A9VZT0, Q83WS0, A6LAR6, Q8A9S8, Q64U80, Q5LD60, A6L4P0, A7GZZ0, A8Z6G1, A3DI22, Q07064, Q891R3, A5N5B3, B9DYW1, P13419, Q97EB3, Q189R2, B8I3S9, A9KNJ5, Q4JVW2, Q6NH87, Q834D6, B0S0G1, Q7VLW6, B8DDM6, Q71YD9, C1KWH6, A0AJY2, Q92AD2, Q8Y624, A1KS57, A9M1J1, Q9JXY2, B4RP08, Q5FAG1, Q9JVY8, Q03FM6, Q7MUZ8, Q98HQ4, Q92N42, Q1MDG4, Q2K5P2, B3PV59, B5ZYA2, C3MFQ8, O66164, Q4L776, Q8CNV9, | P11586 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Finegoldia magna, Haemophilus ducreyi, Listeria monocytogenes, Listeria monocytogenes, Listeria monocytogenes, Listeria welshimeri, Listeria innocua, Listeria monocytogenes, Neisseria meningitidis, Neisseria meningitidis, Neisseria meningitidis, Neisseria gonorrhoeae, Neisseria gonorrhoeae, Neisseria meningitidis, Pediococcus ntosaceus, Porphyromonas gingivalis, Rhizobium loti, Rhizobium meliloti, Rhizobium leguminosarum, Rhizobium etli, Rhizobium etli, Rhizobium leguminosarum, Rhizobium sp., Sphingomonas paucimobilis, Staphylococcus haemolyticus, Staphylococcus epidermidis, Staphylococcus epidermidis, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus sanguinis, Streptococcus pyogenes, Streptococcus uberis, Streptococcus agalactiae, Streptococcus agalactiae, Streptococcus agalactiae, Streptococcus mutans, Streptococcus pneumoniae, Streptococcus pneumoniae, Streptococcus pneumoniae, Streptococcus pneumoniae, Streptococcus equi, Streptococcus equi, Streptococcus pneumoniae, Streptococcus pneumoniae, Streptococcus sanguinis, Streptococcus pneumoniae, Streptococcus pneumoniae, Streptococcus pneumoniae, Streptococcus pneumoniae, Streptococcus equi, Streptococcus suis, Streptococcus suis, Streptococcus pyogenes, Streptococcus pyogenes, Streptococcus pyogenes, Streptococcus pyogenes, Streptococcus pyogenes, Streptococcus pyogenes, Streptococcus pyogenes, | Q5HNH4, B9DN77, Q8NW37, Q6G8J5, Q6GFX6, Q5HF42, Q2G296, A8Z200, A6QHR5, Q2FG06, Q2YTF6, Q7A535, A5ITQ4, Q99TD2, A7X3G5, A6U2J8, Q5X9K7, A2RGS2, P0DF93, P0DF92, Q1J9F2, Q1JJK1, Q1JEK4, Q48QZ2, Q99XR2, Q8NZ49, A3CL27, Q1J4C03 B9DS83, Q8E5E3, Q3K138, Q8DZP5, Q59925, C1QEI6, B1IC26, C1CKW9, B2IP03, C1C7J4, C0MFU5, B4U2T6, C1CR74, Q97QI2, A3CN49, Q8DPL5, B8ZJQ0, Q04K90, B5E4W4, C0M9N3, A4W0G0, A4VU67, Q48TE8, P0DF91, Q1JLK2, Q99ZI9, A2REC4, Q1JBM0, P0DF90, Q5XC12, Q8P0X5, Q1JGN8, Q1J6F7, Q5M083, Q5M4U2, Q03L41 | |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 697 | GPFANIAHGN | Streptococcus pyogenes, Streptococcus pyogenes, Streptococcus pyogenes, Streptococcus thermophilus, Streptococcus thermophilus, Streptococcus thermophilus Lactobacillus delbrueckii, Lactobacillus delbrueckii | Q1GA94, Q04AM0 | P11586 |
| 698 | GPGGYVAAI | Bacillus subtilis, Pseudomonas fluorescens, Pseudomonas aeruginosa, Pseudomonas aeruginosa, Pseudomonas putida, Staphylococcus aureus, Staphylococcus aureus, Staphylococcus aureus, Staphylococcus aureus, Staphylococcus aureus, Staphylococcus aureus, Staphylococcus aureus | P21880, P14218, Q9I3D1, Q9I1L9, P09063, Q6GAB8, P0A0E7, P0A0E8, Q6GHY9, P99084, Q5HGY8, P0A0E6 | P09622 |
| 699 | GPGGYVAAIKAAQLG | Pseudomonas putida | P31052 | P09622 |
| 700 | GPGTGIAPF | Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Klebsiella pneumoniae | A8ANX1, A4WDW1, Q8FEI7, Q1R7T4, Q0TEA2, A1AEV0, A8A3P5, Q8X7U1, A7ZQK7, B1IU77, P38038, A6TD49 | Q9UBK8 |
| 701 | GPNGAGKSTI | Streptococcus pyogenes, Streptococcus pyogenes | P0COE3, P0COE2 | Q8WWZ7 |
| 702 | GPNGAGKTT | Escherichia coli, Escherichia coli, Pseudomonas aeruginosa | P0A9S7, P0A9S8, P21629 | Q86UK0 |
| 703 | GPNGSGKSN | Lactobacillus plantarum, Bacillus subtilis, Fusobacterium nucleatum, Desulfitobacterium hafniense, Clostridium kluyveri | Q88WJ9, P51834, Q8REH4, Q24U48, B9E1H0 | Q8NDV3 |
| 704 | GPNGSGKST | Bacillus halodurans | Q9Z9J3 | Q03519 |
| 705 | GPNTGGMGA | Clostridium acetobutylicum | Q97J90 | P22102 |
| 706 | GPNTGGMGAY | Lactobacillus plantarum, Corynebacterium ammoniagenes, Campylobacter jejuni, Campylobacter jejuni, Corynebacterium glutamicum, Listeria monocytogenes, Listeria innocua, Listeria monocytogenes, Rhizobium loti, Streptococcus pneumoniae, Streptococcus pneumoniae, Streptococcus pyogenes, Streptococcus pyogenes, Streptococcus pyogenes, Streptococcus pyogenes, Streptococcus pyogenes, Streptococcus suis | Q88U30, Q9RHX4, Q9PN47, Q5HTL1, Q8NMH3, Q8Y6C6, Q92AP4, Q71YQ4, Q986A5, Q8DRM0, Q97T98, Q8P308, Q5XEF0, P0DD58, P0DD59, Q9F159 | P22102 Q9A1Y7, |
| 707 | GPNTNGSQFFI | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q6GAX2, Q7A6I1, Q7A1C0, Q6GID4, Q99VD4, Q2FZU9, Q2FIC1, Q2YWT2, Q5HHD1 | A0A0B4J2A2 |
| 708 | GPPGAGKGTQA | Desulfitobacterium hafniense, Desulfitobacterium hafniense, Geobacter lovleyi, Streptomyces avermitilis, Streptomyces coelicolor, Streptomyces griseus, Streptomyces lividans | Q250L1, B8G1Y7, B3E851, Q82DM5, P43414, B1W3Y6, P49974 | P54819 |
| 709 | GPPGCGKTL | Rhizobium sp. | P55530 | Q8NBU5 |
| 710 | GPPGLGKTT | Corynebacterium jeikeium, Corynebacterium aurimucosum, Enterococcus faecalis, Streptococcus gordonii, Streptococcus thermophilus, | Q4JVD9, C3PGQ6, Q839T5, A8AUH0, Q5LXQ9, Q03IE9, Q5M2B1, Q8DWI4, | Q8WVB6 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus thermophilus, Streptococcus thermophilus, Streptococcus mutans, Streptococcus uberis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus agalactiae, Streptococcus suis, Streptococcus suis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus equi, Streptococcus sanguinis, Streptococcus pneumoniae, Streptococcus pneumoniae, Streptococcus equi* | B9DSU1, Q1JP25, Q1JE69, B5XJ28, A2RC05, Q1JJ71, Q1J924, Q5XEE4, Q9A1Y1, Q8P302, P0DF51, Q48VY1, P0DF50, Q8E2D9, Q8E7U6, Q3K3X8, A4VSD3, A4VYM0, C1CPD4, C1CIE0, Q8CVVU7, B1I8Y6, Q04MI9, C1CB34, B5E6T3, C1CC50, C0MC84, A3CK22, B2ISI4, Q97SR6, B4U5F8 | |
| 711 | GPPGLGKTTL | *Arcobacter butzleri, Bacillus halodurans, Helicobacter hepaticus, Staphylococcus saprophyticus, Stenotrophomonas maltophilia, Stenotrophomonas maltophilia* | A8EVP9, Q9KDI8, Q7VIU8, Q49Y79, B45T32, B2FRN4 | Q8WVB6 |
| 712 | GPPGLGKTTLA | *Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas salmonicida, Aeromonas hydrophila, Akkermansia muciniphila, Bacillus cereus, Bacillus cereus, Bacillus cereus, Bacillus cytotoxicus, Bacillus weihenstephanensis, Bacillus methylotrophicus, Lactobacillus johnsonii, Bacillus cereus, Bacillus cereus, Lactobacillus gasseri, Bacillus cereus, Bacillus cereus, Bacillus thuringiensis, Bacillus cereus, Bacillus anthracis, Bacillus anthracis, Bacillus anthracis, Bacillus thuringiensis, Lactobacillus delbrueckii, Lactobacillus delbrueckii, Bacillus subtilis, Lactobacillus acidophilus, Lactobacillus salivarius, Lactobacillus reuteri, Lactobacillus reuteri, Bacillus licheniformis, Lactobacillus casei, Lactobacillus casei, Lactobacillus helveticus, Lactobacillus plantarum, Lactobacillus brevis, Fusobacterium nucleatum, Bifidobacterium adolescentis, Bifidobacterium longum, Desulfitobacterium hafniense, Desulfitobacterium hafniense, Bifidobacterium longum, ptoclostridium difficile, Clostridium novyi, Clostridium perfringens, Clostridium perfringens, Clostridium* | A3M7W1, B2HWT3, B0VDI5, B7GYB5, B0VT89, B7I5A9, Q6F991, A4SJ26, A0KPA2, B2UPI9, B7IIT2, B7HE54, Q817W4, A7GTA2, A9VIP6, A7Z768, P61533, B7HQH9, P61528, Q045Q2, B9IYZ4, Q634C4, Q6HDA6, C1ESW4, Q81LG9, C3L6U9, C3P9A7, A0RJ26, Q048Y7, Q1G941, O32055, Q5FLX2, Q1WT18, B2G6E8, A5VIX2, Q65GP6, B3WC56, Q03B17, A8YTI2, Q88V03, Q03R36, Q8RE97, A1A1K3, B7GR18, Q24UN7, B8FQV5, Q8G6B7, Q183N8, A0PZV4, Q0TP13, Q8XJ14, Q891Z8, Q97GT1, A6LTM7, Q0SRN3, A9KP49, A3DBU4, A5N206, B9E5Q8, B1IMF3, A7GHT8, C1FKG1, C3KTD2, A5I6F1, A7FY19, B1L0B2, B2TMZ2, B2V338, A5G9Y2, B3E468, B9LZC4, P61532, | Q8WVB6 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | tetani, Clostridium acetobutylicum, Clostridium beijerinckii, Clostridium perfringens, Clostridium phytofermentans, Clostridium thermocellum, Clostridium kluyveri, Clostridium kluyveri, Clostridium botulinum, Clostridium botulinum, Clostridium botulinum, Clostridium botulinum, Clostridium botulinum, Clostridium botulinum, Clostridium botulinum, Clostridium botulinum, Clostridium botulinum, Geobacter uraniireducens, Geobacter lovleyi, Geobacter daltonii, Geobacter sulfurreducens, Geobacter bemidjiensis, Geobacter metallireducens, Geobacter sp., Haemophilus influenzae, Haemophilus influenzae, Haemophilus influenzae, Haemophilus ducreyi, Haemophilus somnus, Leuconostoc mesenteroides, Listeria innocua, Listeria monocytogenes, Listeria monocytogenes, Listeria welshimeri, Listeria monocytogenes, Listeria monocytogenes, Pediococcus ntosaceus, Proteus mirabilis, Pseudomonas putida, Pseudomonas entomophila, Pseudomonas syringae, Pseudomonas mendocina, Pseudomonas savastanoi, Pseudomonas fluorescens, Pseudomonas aeruginosa, Pseudomonas putida, Pseudomonas aeruginosa, Pseudomonas aeruginosa, Pseudomonas aeruginosa, Pseudomonas syringae, Pseudomonas putida, Pseudomonas fluorescens, Pseudomonas putida, Pseudomonas stutzeri, Pseudomonas fluorescens, Rhizobium loti | B5EAH3, Q39XN6, C6E1S8, Q4QNM6, P44631, A5UAH8, Q7VKV5, Q011M3, Q03YJ6, Q92B12, Q8Y6Z8, B8DHL6, A0AIY1, Q71ZD8, C1KVH9, Q03ER0, B4ETP8, B1JD70, Q1I6E9, Q4ZWL1, A4XRS1, Q48FC5, Q3K7W0, A6VA05, B0KTJ2, Q02IC9, B7UXW5, Q51426, Q87Y35, Q88NJ0, C3JYS7, A5VZU7, A4VNA3, Q4K7D9, Q98F76 | |
| 713 | GPPGLGKTTLAH | Campylobacter concisus, Campylobacter hominis, Campylobacter fetus, Campylobacter curvus, Neisseria gonorrhoeae, Neisseria gonorrhoeae, Neisseria meningitidis, Neisseria meningitidis, Neisseria meningitidis, Neisseria meningitidis, Ralstonia pickettii, Ralstonia solanacearum | A7ZEM1, A7I1C5, A0RN84, A7GZP9, B4RLV8, Q5F8L2, A1KU52, Q9JZ86, A9LZC3, Q9JUB0, B2UFL1, Q8Y236 | Q8WVB6 |
| 714 | GPPGSGKGT | Micrococcus luteus, Micrococcus luteus | P33107, C5CC42 | P27144 |
| 715 | GPPGTGKTL | Clostridium phytofermentans, Pseudomonas putida | A9KIG5, A5W382 | Q9Y4W6 |
| 716 | GPPGTGKTLLA | Bacillus pseudofirmus, Corynebacterium glutamicum, Haemophilus influenzae, Propionibacterium acnes, Slackia heliotrinireducens, Staphylococcus haemolyticus | P94304, Q6M2F0, P71377, D4HA34, C7N1I1, Q4L3G8 | Q9Y4W6 |
| 717 | GPPGTGKTLLAKA | Bacillus subtilis, Lactobacillus plantarum, Lactobacillus plantarum, Parabacteroides distasonis, Clostridium novyi, Clostridium cellulolyticum, Clostridium perfringens, Escherichia coli, Escherichia coli, Helicobacter felis, Helicobacter pylori, Helicobacter pylori, Leuconostoc mesenteroides, Streptococcus pneumoniae, | P37476, Q88Z31, C6VKW6, A6LD25, A0PXM8, B8I4B9, Q0TTK8, P0AAI3, Q8X9L0, O32617, Q9ZM66, P71408, Q03Z46, O69076, P59652, D1BLD0 | Q9Y4W6 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Streptococcus pneumoniae, Veillonella parvula | | |
| 718 | GPPGTGKTT | Escherichia coli, Escherichia coli, Escherichia coli, Haemophilus influenzae | P0AAZ5, P0AAZ4, P0AAZ6, P45262 | P35250 |
| 719 | GPPGVGKTS | Acinetobacter baumannii, Bacillus thuringiensis, Bacillus subtilis, Campylobacter concisus, Clostridium beijerinckii, Desulfovibrio desulfuricans, Desulfovibrio vulgaris, Escherichia coli, Escherichia coli, Geobacter bemidjiensis, Geobacter metallireducens, Geobacter lovleyi, Haemophilus influenzae, Rhizobium meliloti | B7GXS7, A0RJ87, P37945, A7ZEJ3, A6LSV5, B8J198, Q72CE6, P0A9M0, P0A9M1, B5EDX8, Q39OP7, B3E7K2, P43864, O69177 | P36776 |
| 720 | GPPGVGKTSIA | Clostridium acetobutylicum, Uncultured termite | Q97FT9, B1GZQ6 | P36776 |
| 721 | GPPHDRRFT | Geobacter metallireducens | Q39T82 | P19525 |
| 722 | GPQHPAAHGVLRLV | Stenotrophomonas maltophilia | B4SJH6 | O75306 |
| 723 | GPRYCPSIE | Bacillus halodurans, Bacillus methylotrophicus, Bacillus clausii, Bacillus subtilis, Bacillus pumilus, Lactobacillus delbrueckii, Lactobacillus delbrueckii, Lactobacillus sakei, Lactobacillus plantarum, Lactobacillus salivarius, Lactobacillus brevis, Desulfitobacterium hafniense, Desulfitobacterium hafniense, Campylobacter curvus, Campylobacter concisus, Clostridium acetobutylicum, Clostridium kluyveri, Clostridium beijerinckii, ptoclostridium difficile, Clostridium perfringens, Clostridium perfringens, Clostridium perfringens, Helicobacter acinonychis, Pediococcus ntosaceus | Q9RCA8, A7ZAW0, Q5WAG4, P25812, A8FJF9, Q1G7Z5, Q047G0, Q38UF0, Q88RX6, Q1WVH6, Q03N65, Q24M99, B8GOL2, A7GWM5, A7ZBK0, Q97CVV3, A5N450, A6M3M4, Q18IS8, Q0TLZ5, Q8XH31, Q0SPQ4, Q17VU9, Q03D60 | Q9Y2Z2 |
| 724 | GPSGAGKST | Clostridium tetani, Haemophilus influenzae | Q895P5, P45092 | Q16774 |
| 725 | GPSGAGKSTF | Bacillus subtilis, Bacillus halodurans | O34814, Q9KFL0 | Q9H172 |
| 726 | GPSGAGKSTL | Clostridium botulinum, Clostridium botulinum, Clostridium beijerinckii, Escherichia coli, Escherichia coli, Escherichia coli | B2V4B8, B2THS4, A6LSK4, P31548, Q8XA06, Q1RGD0 | Q16774 |
| 727 | GPSGAGKSTLL | Clostridium perfringens, Clostridium perfringens, Clostridium perfringens, Escherichia coli, Escherichia coli | Q0TPL7, Q8XJL9, Q0SS84, Q8FL82, Q0TLS2 | Q16774 |
| 728 | GPSGSGKSS | Rhizobium sp. | P55453 | Q9NP78 |
| 729 | GPSGSGKST | Bacillus subtilis, Rhizobium leguminosarum | P54537, Q52815 | Q9NRK6 |
| 730 | GPTGSGKTLLA | Aeromonas hydrophila, Aeromonas salmonicida, Citrobacter koseri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus ducreyi, Klebsiella pneumoniae, Klebsiella pneumoniae, Proteus mirabilis, Pseudomonas putida, Pseudomonas putida, Pseudomonas putida, Pseudomonas putida, Pseudomonas mendocina, Pseudomonas syringae, | A0KJU2, A4SM43, A8AK15, A4W7A9, B7LME1, Q1RF97, B1LJJ5, B6HZP5, B7N8Z2, B1J010, P0A6H1, P0A6H2, Q0TKK3, A1A8A7, A7ZX96, B1XFM6, C4ZTJ5, B7M3T1, B7MQF4, B7NJ56, B5Z3U5, P0A6H3, B7L675, B7MD97, B7UJR1, A7ZIJ6, Q7VP79, B5YOU1, A6T5I1, B4EU54, A5W634, B0KJG7, Q88KI9, B1J693, A4XTZ6, Q87YR7, Q4ZVM6, Q9I2U0, A6V718, Q02KU5, B7VB75, Q48KY9, | O76031 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Pseudomonas syringae, Pseudomonas aeruginosa, Pseudomonas aeruginosa, Pseudomonas aeruginosa, Pseudomonas aeruginosa, Pseudomonas savastanoi, Pseudomonas fluorescens, Pseudomonas fluorescens, Stenotrophomonas maltophilia, Stenotrophomonas maltophilia | Q3K9X0, C3JYJ9, B2FQR3, B4SLN2 | |
| 731 | GPTGSGKTLLAQ | Neisseria meningitidis, Neisseria meningitidis, Neisseria meningitidis, Neisseria meningitidis | A9M020, A1KUJ4, Q9JTX8, Q9JYY3 | O76031 |
| 732 | GPTGSGKTLLAQT | Sphingomonas wittichii | A5V3U4 | O76031 |
| 733 | GPTGSGKTLLAQTLA | Acinetobacter baylyi, Acinetobacter baumannii, Acinetobacter baumannii, Acinetobacter baumannii, Acinetobacter baumannii, Acinetobacter baumannii, Acinetobacter baumannii, Bacillus pumilus, Bacillus licheniformis, Bacillus subtilis, Bacillus thuringiensis, Bacillus cereus, Bacillus cereus, Bacillus cereus, Bacillus cereus, Bacillus cereus, Bacillus cereus, Bacillus anthracis, Bacillus anthracis, Bacillus anthracis, Bacillus methylotrophicus, Bacillus cereus, Bacillus cereus, Bacillus cereus, Bacillus cytotoxicus, Bacillus clausii, Bacillus halodurans, Methylobacterium sp., Methylobacterium extorquens, Methylobacterium extorquens, Methylobacterium radiotolerans, Methylobacterium nodulans, Methylobacterium populi, Haemophilus influenzae, Haemophilus somnus, Listeria innocua, Listeria monocytogenes, Listeria monocytogenes, Listeria monocytogenes, Listeria monocytogenes, Listeria welshimeri, Ralstonia solanacearum, Ralstonia pickettii | Q6FEP7, B0V4T7, A3M1Y8, B0VKU4, B2I3C2, B7I5E4, B7H092, A8FFV9, Q65GJ4, P50866, Q6HD54, Q633X2, B7HQN2, B9IZ47, C1ETR8, Q72ZV4, B7JQ65, Q81LB9, C3L704, C3P9F7, A7Z7B2, Q817Q2, B7HEA4, B7IIY3, A7GTF1, Q5WEN9, Q9K8F4, B0UD19, B7KNT1, A9W5F6, B1LW29, B8IN27, B1Z9C8, P44838, Q0I4F0, Q92C84, Q8Y7K9, C1L2H6, B8DHN7, Q720F3, A0AI71, Q8XYP6, B2UFQ3 | O76031 |
| 734 | GPTGSGKTLLAQTLAK | Campylobacter jejuni, Staphylococcus carnosus, Staphylococcus epidermidis, Staphylococcus epidermidis | Q9PIM0, B9DNC0, Q8CNY5, Q5HNM9 | O76031 |
| 735 | GQDPYHGPNQA | Streptococcus mutans | Q8DTV8 | P13051 |
| 736 | GQDVLLFIDNIFRF | Clostridium thermocellum | A3DIM9 | P06576 |
| 737 | GQEVTLCGW | Edwardsiella ictaluri, Pseudomonas aeruginosa, Pseudomonas aeruginosa, Pseudomonas aeruginosa, Pseudomonas fluorescens, Pseudomonas putida, Pseudomonas putida, Pseudomonas putida, Pseudomonas entomophila, Pseudomonas putida | C5B957, Q51422, B7UXW9, Q02IC5, Q4K7D5, Q88NJ4, A5VZU3, B0KTJ6, Q1I6E5, B1JD74 | Q6PI48 |
| 738 | GQKCSACSR | Bacillus thuringiensis, Bacillus cereus, Bacillus cereus, Bacillus anthracis, Bacillus cereus, Bacillus cereus, Bacillus cereus, Bacillus cereus, Bacillus cereus, Bacillus anthracis, Bacillus thuringiensis, Bacillus anthracis, Bacillus weihenstephanensis, Bacillus cereus, Bacillus cytotoxicus, Bacillus cereus, Bacillus cereus, Bacillus cereus | Q6HP91, B9J1L9, Q63GS0, C3PBP4, B7HSW8, C1EV77, B7JM99, C3L546, A0R909, Q81ZF8, A9VRG6, P62028, A7GKJ4, Q81IP0, B7H4V1, B7IUW8 | P30038 |
| 739 | GQMNEPPGAR | Clostridium perfringens, Clostridium perfringens, Clostridium perfringens | Q0SQZ5, Q0TNC4, Q8XID4 | P06576 |
| 740 | GQRELIIGDRQ | Clostridium novyi | A0Q2Z6 | P25705 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 741 | GQRELIIGDRQTGKT | Clostridium botulinum, Clostridium botulinum, Clostridium botulinum, Clostridium botulinum, Clostridium botulinum, Clostridium botulinum, Clostridium botulinum, Clostridium botulinum, Clostridium acetob TABLE 1-continued Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | meningitidis, Ralstonia solanacearum, Ralstonia pickettii | B2UGW0 | |
| 755 | GRNIIHGSDS | Staphylococcus epidermidis, Staphylococcus epidermidis | Q5HP76, Q8CSI0 | O60361 |
| 756 | GRPGWHIECS | Lactobacillus plantarum, Lactobacillus brevis, Lactobacillus fermentum, Lactobacillus salivarius, Eubacterium eligens, Clostridium perfringens, Clostridium perfringens, Clostridium perfringens, Clostridium botulinum, Clostridium botulinum, Clostridium tetani, Clostridium beijerinckii, Clostridium kluyveri, Clostridium kluyveri, Clostridium botulinum, Clostridium botulinum, Clostridium botulinum, Clostridium botulinum, Clostridium botulinum, Clostridium botulinum, Clostridium botulinum, Clostridium botulinum, ptoclostridium difficile, Clostridium phytofermentans, Leuconostoc mesenteroides, Pediococcus ntosaceus, Pseudomonas fluorescens, Pseudomonas syringae, Pseudomonas fluorescens, Pseudomonas syringae, Pseudomonas putida, Pseudomonas putida, Pseudomonas savastanoi, Pseudomonas putida, Pseudomonas aeruginosa, Pseudomonas aeruginosa, Pseudomonas aeruginosa, Pseudomonas aeruginosa, Pseudomonas fluorescens, Pseudomonas entomophila, Pseudomonas stutzeri, Pseudomonas putida, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Staphylococcus haemolyticus, Streptococcus pneumoniae, Streptococcus pneumoniae, Streptococcus mutans, Streptococcus equi, Streptococcus thermophilus, Streptococcus thermophilus, Streptococcus pyogenes, Streptococcus pyogenes, Streptococcus pyogenes, Streptococcus pyogenes, Streptococcus pyogenes, Streptococcus pyogenes | Q88YX9, Q03SU6, B2GAB5, Q1WSS5, C4Z3N5, Q0TMM4, Q0SQC1, Q8XHQ5, B2TIF6, B2UY90, Q890M4, A6LPP1, A5N4M6, B9DY88, B1IGH6, C1FMX3, A5I7M8, A7FZ91, A7GJ96, B1KTA5, C3KVS3, Q18CD5, A9KSM5, Q03ZR0, Q03E41, Q4K9S1, Q4ZVN9, C3JYD3, Q87YQ2, B0KUU0, A5W458, Q48L06, Q88IU4, Q02KT6, Q9I2U7, B7VB84, A6V727, Q3KA28, Q1IBP9, A4VL73, B1J805, Q6GJD9, A8YZM7, Q5HIE5, Q2G2M6, A6QEI2, Q2FJB0, Q99W73, Q932G0, A5IQ83, A7WYU7, A6TZ06, Q8NXY7, Q6GBV8, Q2YSD1, Q49V39, Q4L3I9, Q8D058, Q97S25, Q8DWA9, B4U570, Q5M6F6, Q5M1W6, Q99XZ9, Q5X9W5, P0DG33, P0DG32, Q48RA7, Q8NZD1 | P49589 |
| 757 | GRPGWHIECSA | Listeria innocua, Listeria monocytogenes, Listeria monocytogenes, Listeria monocytogenes, Listeria welshimeri | Q92F36, Q8YAB1, C1KYH2, B8DF15, Q724H3, A0AF38 | P49589 |
| 758 | GRPGWHIECSAM | Acinetobacter baumannii, Acinetobacter baumannii, Acinetobacter baumannii, Acinetobacter baumannii, Acinetobacter baumannii, Acinetobacter baumannii, | B0V571, B0VAU1, B7GWA1, B7IBU3, B2HX34, A3M419, Q6FC71, A8F962, Q5WLT3, Q72BNQ5, A1VDQ5, B8DKL0, | P49589 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Acinetobacter baylyi, Bacillus pumilus, Bacillus clausii, Desulfovibrio vulgaris, Desulfovibrio vulgaris, Desulfovibrio vulgaris, Desulfovibrio alaskensis, Desulfovibrio desulfuricans, Enterobacter sp., Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter sulfurreducens, Geobacter sp., Geobacter bemidjiensis, Geobacter metallireducens, Haemophilus ducreyi, Haemophilus influenzae, Haemophilus influenzae, Haemophilus somnus, Klebsiella pneumoniae, Klebsiella pneumoniae, Neisseria gonorrhoeae, Neisseria meningitidis, Neisseria meningitidis, Proteus mirabilis, Ralstonia pickettii, Ralstonia solanacearum, Rhizobium etli, Rhizobium leguminosarum, Rhizobium leguminosarum, Rhizobium loti, Rhizobium etli, Rhizobium meliloti | Q30ZH8, B8J052, A4W7I4, P21888, C4ZUX4, B1XGC4, Q0TKB5, B1LKE5, B7LJI4, B6I0H1, Q1RF08, Q8FK44, B1IZ75, A1A8J2, B7M4M9, A7ZXI1, B7MRI9, B5YPP1, B7NL20, B7L7F3, B7ME49, Q8XCT9, A7ZIT5, B7N980, B7UKK3, Q747A2, C6E7P0, B5EEK6, Q39ZL8, Q7VMA0, Q4QPG7, A5UFP3, P43816, Q0I1Q1, A6T5R2, B5Y0K6, Q5F5D6, Q9JXE6, Q9JWJ3, B4F1M6, B2U9P8, Q8Y077, Q2KAA8, Q1MJ22, B5ZWB3, Q984X8, B3PUS4, Q92R20 | |
| 759 | GRPGWHIECSAMA | Bacillus cereus, Bacillus cereus, Bacillus cereus, Bacillus cereus, Bacillus thuringiensis, Bacillus cereus, Bacillus anthracis, Bacillus anthracis, Bacillus cereus, Bacillus anthracis, Bacillus cereus, Bacillus cereus, Bacillus cereus, Bacillus thuringiensis, Corynebacterium jeikeium | Q81J59, B7HJ28, C1ET19, Q73FB7, Q6HPS8, Q63HB0, Q8VV1, C3P9N5, B7JK97, C3LJ62, B7ISZ9, B9IZH4, B7HQS4, A0R8G1, Q4JXJ2 | P49589 |
| 760 | GRSNVGKSS | Bacillus halodurans, Bacillus clausii, Bacillus cytotoxicus, Bacillus weihenstephanensis, Bacillus cereus, Bacillus cereus, Bacillus cereus, Bacillus thuringiensis, Bacillus anthracis, Bacillus cereus, Bacillus cereus, Bacillus cereus, Bacillus anthracis, Bacillus cereus, Bacillus thuringiensis, Bacillus anthracis, Bacillus methylotrophicus, Bacillus licheniformis, Lactobacillus delbrueckii, Lactobacillus delbrueckii, Bacillus subtilis, Bacillus pumilus, ptoclostridium difficile, Enterococcus faecalis, Finegoldia magna, Listeria welshimeri, Listeria innocua, Listeria monocytogenes, Listeria monocytogenes, Listeria monocytogenes, Listeria monocytogenes, Staphylococcus haemolyticus, Streptococcus mutans, Streptococcus equi, Streptococcus equi, Streptococcus pneumoniae, Streptococcus pneumoniae, Streptococcus pneumoniae, Streptococcus pneumoniae, Streptococcus uberis, Streptococcus pneumoniae, Streptococcus sanguinis, Streptococcus pyogenes, Streptococcus pneumoniae, | Q9K8F7, Q5WEP2, A7GTE8, A9VIU3, B7IIY0, Q817Q5, B7HEA1, Q6HD57, Q81LC2, Q633X5, C1ETR5, B9IZ44, B7HQM9, B7JQ62, C3P9F4, Q72ZV7, A0RJ86, C3L700, A7Z7A9, Q65GJ7, Q04B34, Q1GAP7, P38424, A8FFV6, Q180E5, Q833M8, B0S273, A0AJ07, Q92BF6, B8DHJ0, Q71ZB0, C1KVK5, Q8Y6X3, Q4L712, Q8DUH9, C0MA50, C0MEW6, B2IR86, C1CSI8, B8ZLT0, B1ICY8, B9DU74, C1CFF1, A3CMV2, Q8P1C8, P64073, P64072, C1C8F9, B5E6L1, Q04JI0, C1CLR7, Q48U21, A2RF16, Q1J740, Q5XCL9, Q9A088, B5XL04, Q1JHC1, Q1JM76, Q1JC92, Q03LM9, Q8DZ11, | Q8N3Z3 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Streptococcus pneumoniae, Streptococcus pneumoniae, Streptococcus pneumoniae, Streptococcus pneumoniae, Streptococcus pneumoniae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus thermophilus, Streptococcus agalactiae, Streptococcus agalactiae, Streptococcus agalactiae, Streptococcus pyogenes, Streptococcus pyogenes, Streptococcus gordonii, Streptococcus thermophilus, Streptococcus thermophilus | Q3K0K1, Q8E4L9, P0DA93, P0DA92, A8AX68, Q5M053, Q5M5A9 | |
| 761 | GRSNVGKSSL | Lactobacillus brevis, Lactobacillus reuteri, Lactobacillus reuteri, Lactobacillus fermentum, Desulfovibrio desulfuricans, Desulfovibrio alaskensis, Desulfovibrio vulgaris, Desulfovibrio vulgaris, Geobacter sp., Geobacter bemidjiensis, Leuconostoc citreum, Leuconostoc mesenteroides, Pediococcus ntosaceus | Q03QN8, B2G6R5, A5VJ95, B2GBC5, B8J030, Q30ZZ9, A1VDC5, Q72BH2, C6E8C5, B5EEM1, B1MXT9, Q03W10, Q03F28 | Q8N3Z3 |
| 762 | GRSNVGKSSLI | Lactobacillus plantarum, Lactobacillus salivarius, Desulfitobacterium hafniense, Desulfitobacterium hafniense, Desulfovibrio salexigens, Rhizobium etli, Rhizobium sp., Rhizobium etli, Rhizobium loti, Rhizobium leguminosarum, Rhizobium leguminosarum | Q88VE3, Q1WUI3, Q245K9, B8FVH0, C6BUE5, B3Q039, C3MF47, Q2KD28, Q98D85, Q1MM59, B5ZN41 | Q8N3Z3 |
| 763 | GRVKTLHPA | Clostridium novyi, Listeria monocytogenes, Listeria monocytogenes, Listeria monocytogenes, Listeria innocua, Listeria welshimeri, Listeria monocytogenes, Pediococcus ntosaceus | A0Q1J0, Q71YQ3, Q8Y6C5, C1KW64, Q92AP3, A0AJL9, B8DDZ2, Q03E83 | P31939 |
| 764 | GRVKTLHPAVH | Clostridium tetani, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus haemolyticus, Staphylococcus carnosus | Q892X3, Q6GI11, Q2YX50, P67544, A5IRW0, P67543, A6U0P1, Q8CT27, Q5HQ97, Q2FI05, Q5HH11, Q8NX88, Q6GAE0, Q2FZI6, A6QFT1, Q4L582, B9DQ42 | P31939 |
| 765 | GRVQGVCFR | Rhizobium meliloti | Q92TK9 | P14621 |
| 766 | GRYREFYQCD | Clostridium acetobutylicum | Q97FJ7 | P12081 |
| 767 | GSDFIKTSTG | ptoclostridium difficile | Q18C22 | Q9Y315 |
| 768 | GSIRSPLWRGG | Desulfovibrio vulgaris, Desulfovibrio vulgaris | A1VEB5, Q72CH9 | Q9BYD3 |
| 769 | GSLTTPPCSE | Klebsiella pneumoniae | O52535 | P23470 |
| 770 | GSLTTPPCTE | Neisseria gonorrhoeae | Q50940 | P23280 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 771 | GSPAEKAGL | Bacillus subtilis, Neisseria meningitidis, Neisseria meningitidis | Q34358, Q9K1G9, Q9JX32 | O14745 |
| 772 | GSSQRFGVP | Propionibacterium acnes, Pseudomonas fluorescens, Rhizobium leguminosarum | Q6A9R8, Q3K4Z1, Q1MG62 | P23378 |
| 773 | GSVPHGGFG | Streptococcus thermophilus, Streptococcus thermophilus, Streptococcus thermophilus, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus agalactiae, Streptococcus pyogenes, Streptococcus suis, Streptococcus suis | Q5M067, Q5M458, Q03L20, A2RFM5, P0DG29, Q48UH6, Q1JHS6, P67577, P0DG28, P67575, Q1JMN3, Q1JCQ7, Q5XD20, P67574, P67573, Q3K2E5, Q1J7K5, A4W083, A4VTZ1 | Q96159 |
| 774 | GTDVAKEAS | Bacillus subtilis | O34431 | Q01814 |
| 775 | GTGKTLLAR | Bacteroides thetaiotaomicron, Bacteroides fragilis, Bacteroides fragilis, Porphyromonas gingivalis, Porphyromonas gingivalis | Q8A128, Q64NW3, Q5L8L7, Q7MX10, B2RL24 | P62195 |
| 776 | GTIGHVDHG | Arcobacter butzleri, Lactobacillus helveticus, Lactobacillus johnsonii, Lactobacillus gasseri, Lactobacillus acidophilus, Lactobacillus casei, Lactobacillus casei, Lactobacillus delbrueckii, Lactobacillus delbrueckii, Lactobacillus plantarum, Bacillus cytotoxicus, Lactobacillus sakei, Bacillus weihenstephanensis, Bacillus thuringiensis, Bacillus cereus, Bacillus cereus, Bacillus cereus, Bacillus cereus, Bacillus thuringiensis, Bacillus cereus, Bacillus anthracis, Bacillus anthracis, Bacillus anthracis, Bacillus cereus, Bacillus cereus, Bacillus cereus, Bacillus cereus, Lactobacillus salivarius, Bacillus subtilis, Lactobacillus fermentum, Bacillus pumilus, Bacteroides fragilis, Bacteroides fragilis, Bacteroides thetaiotaomicron, Bacteroides vulgatus, Campylobacter fetus, Campylobacter curvus, Campylobacter concisus, Campylobacter hominis, Campylobacter lari, Campylobacter jejuni, Campylobacter jejuni, Campylobacter jejuni, Campylobacter jejuni, Campylobacter jejuni, Clostridium botulinum, Clostridium botulinum, Clostridium botulinum, Clostridium botulinum, Clostridium botulinum, Clostridium kluyveri, Clostridium novyi, Clostridium tetani, Clostridium perfringens, Clostridium perfringens, Clostridium perfringens, Clostridium acetobutylicum, Clostridium beijerinckii, Clostridium thermocellum, Clostridium cellulolyticum, Enterococcus faecalis, Geobacter uraniireducens, Geobacter sulfurreducens, Geobacter metallireducens, Helicobacter pylori, | A8EW02, A8YUS2, Q74JU6, Q042T5, Q5FKR8, B3WE38, Q039K9, Q04B37, Q1GAQ0, Q88VE0, A7GK18, Q38WR7, A9VP75, Q6HPR0, Q814C4, Q63H92, B7HJ46, C1ET37, A0R8H8, B7JKB7, C3LJ80, Q81VT2, C3P9Q3, B9IZJ2, B7HQU2, Q73F98, B7IT17, Q1WU83, P33166, B2GBC2, A8F982, P33165, Q5L890, Q8A463, A6KYK9, A0RQJ3, A7GZK6, A7ZCN0, A7I3U7, B9KFF9, Q5HVZ7, O69303, A1VYI6, A7H4R3, A8FKQ5, B1KSM7, A5I7K8, A7GJ76, B1IGF6, A7FZ71, A5N4N1, A0PXT1, Q877L9, Q0SQQ8, Q8XFP8, Q0TMN0, Q97EH5, A6LPP6, A3DJ00, B8I5N8, Q839G8, A5GAW4, Q748X8, Q39Y08, B5Z8K3, B2UUW8, P56003, B6JN44, Q17VM8, Q03YI2, B1MY04, Q03F25, Q2K9N2, Q2K9L8, P75022, Q925Y6, Q1MIE3, Q981F7, A5V604, A8YZP5, P64029, Q6GBT9, P99152, Q6GJC0, P64028, A6QEK0, | P49411 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Helicobacter pylori, Helicobacter pylori, Helicobacter pylori, Helicobacter acinonychis, Leuconostoc mesenteroides, Leuconostoc citreum, Pediococcus ntosaceus, Rhizobium etli, Rhizobium etli, Rhizobium radiobacter, Rhizobium meliloti, Rhizobium leguminosarum, Rhizobium loti, Sphingomonas wittichii, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus carnosus, Staphylococcus haemolyticus* | Q5HIC7, Q2YSB3, A5IQA2, Q2G0N0, A6TZ25, Q2FJ92, A7WYX6, Q8CQ81, Q5HRK4, B9DKV8, Q4L3K9 | |
| 777 | GTKFDSSLDR | *Neisseria meningitidis, Neisseria meningitidis* | P56989, P0A0W2 | Q02790 |
| 778 | GTPDYLAPE | *Streptomyces coelicolor* | P54740 | Q96GX5 |
| 779 | GTPVLDIKPY | *Pseudomonas aeruginosa* | Q9RPT0 | Q9BU70 |
| 780 | GTQYRSAIY | *Corynebacterium diphtheriae* | Q6NEL2 | Q9UJ68 |
| 781 | GTQYRSAIYP | *Escherichia coli* | B6I2D2 | Q9UJ68 |
| 782 | GTSSLRRAAQL | *Listeria monocytogenes, Listeria monocytogenes, Listeria monocytogenes, Listeria innocua* | B8DHJ2, C1KVK3, Q71ZB2, Q8Y6X5, Q92BF8 | P08397 |
| 783 | GTSSRSTKL | *Bacillus subtilis, Enterococcus casseliflavus, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Streptococcus pneumoniae, Streptococcus pyogenes, Streptococcus pyogenes, Streptococcus pyogenes, Streptococcus pyogenes, Streptococcus pyogenes* | P18158, O86963, Q8CPE6, Q5HPP0, Q4L608, Q2YXR5, Q6GHD4, Q7A105, Q6G9R2, Q99UH2, Q7A5V7, Q2FYZ4, Q5HGD1, Q2FHD8, Q49X94, P35596, P0DB21, P0DB20, Q8NZX0, Q5XAK0, Q99YI8 | P43304 |
| 784 | GTVGAVALD | *Escherichia coli* | P37595 | Q7L266 |
| 785 | GTVTAANSS | *Bacillus subtilis* | O07618 | P55084 |
| 786 | GVAHAGWKGT | *Bacillus subtilis* | O31726 | Q8IV20 |
| 787 | GVDEAGRGP | *Acinetobacter baylyi, Bacillus methylotrophicus, Fusobacterium nucleatum, Clostridium cellulolyticum, Geobacter daltonii, Geobacter metallireducens, Neisseria meningitidis, Neisseria gonorrhoeae, Neisseria meningitidis, Neisseria meningitidis, Neisseria meningitidis, Ralstonia pickettii, Ralstonia solanacearum* | Q6FCT7, A7Z4M6, Q8RDX3, B8I7T9, B9M597, Q39RP1, A1KRM4, Q5F5X9, Q9K1G1, Q9JX40, A9M3R5, B2UBB5, Q8XZH7 | O75792 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 788 | GVENLRVVDASIMP | Citrobacter koseri | A8AJN0 | Q8NE62 |
| 789 | GVGERTREGND | Neisseria gonorrhoeae, Neisseria gonorrhoeae | Q5F4Z0, B4RJG0 | P06576 |
| 790 | GVGERTREGNDLY | Clostridium novyi, Clostridium kluyveri, Clostridium botulinum, Clostridium botulinum, Clostridium botulinum, Clostridium botulinum, Clostridium botulinum, Clostridium botulinum, Clostridium botulinum, Clostridium acetobutylicum | A0Q2Z4, A5N3H7, A7G909, B1IE34, B1KSS8, C1F0P5, A7FQH9, C3KYJ3, A5HY52, Q9Z687 | P06576 |
| 791 | GVHRVQRVP | Desulfitobacterium hafniense, Desulfitobacterium hafniense, Clostridium cellulolyticum, Clostridium botulinum, Clostridium thermocellum, Clostridium botulinum, Clostridium botulinum, Clostridium botulinum, Clostridium botulinum, Clostridium botulinum, Clostridium botulinum, Clostridium tetani, Clostridium beijerinckii, Clostridium novyi, Clostridium botulinum, Clostridium botulinum, Finegoldia magna, Rhizobium loti, Rhizobium meliloti, Rhizobium etli, Rhizobium leguminosarum, Rhizobium leguminosarum, Sphingomonas wittichii | B8FZ76, Q24ML9, B8I562, C3KYH5, A3DIL4, A7G9P2, B1IE21, C1F097, A5HY35, A7FQG2, B1KSR1, Q898Y5, A6LQG2, A0Q312, B2TJY5, B2UZI5, B0S2B6, Q98G93, Q92MK5, Q2K3T1, B5ZRR4, Q1MBB2, A5V9C3 | Q9UGC7 |
| 792 | GVHRVQRVPKTE | Fusobacterium nucleatum | Q8R5W0 | Q9UGC7 |
| 793 | GVIINTASV | Clostridium scindens | P19337 | Q99714 |
| 794 | GVKKGDRW | Campylobacter jejuni, Campylobacter jejuni, Campylobacter jejuni | A1W1D6, Q9PMD2, A8FNJ7 | Q86V21 |
| 795 | GVLGEHGRG | Geobacter daltonii | B9M8U3 | O15269 |
| 796 | GVLVPGGFG | Clostridium perfringens, Clostridium perfringens, Clostridium perfringens, Desulfovibrio salexigens | Q0SQX5, Q0TNA4, Q8XIB3, C6BWN7 | P17812 |
| 797 | GVMLRGSGI | Campylobacter jejuni, Campylobacter jejuni, Campylobacter jejuni, Campylobacter jejuni, Campylobacter jejuni | A7H5S8, A8FNN4, A1W1H5, Q5HSL5, Q9PM99 | O75306 |
| 798 | GVPFNIASYAL | Clostridium cellulolyticum | B8I0T8 | P04818 |
| 799 | GVPIIADGGI | Bacillus halodurans | Q9KGN8 | P20839 |
| 800 | GWDAFGLPAE | Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis | A8AJG0, C5BGC7, A4W827, A7ZJ31, B1LL91, Q1RER9, A1A8R7, B7MFR5, A7ZXR8, B1IYG6, B7UKT2, P07813, C4ZWC9, B7NM01, Q0TK31, B7LLH1, B7M5G9, B7L9I6, B6I153, Q8FJY9, B7MRS9, B5YQJ4, Q8XBN8, B7N9P8, A6T6A3, B5XZR2, B4EV14 | O15031 |
| 801 | GWDCHGLPVE | Propionibacterium acnes, Streptomyces coelicolor, Streptomyces avermitilis | Q6AB89, Q9S2X5, Q82AC9 | P41252 |
| 802 | GWKEIEYEV | Eubacterium rectale, Clostridium perfringens, Clostridium perfringens, Clostridium perfringens, Clostridium botulinum, Clostridium botulinum, Clostridium botulinum, Clostridium botulinum, Clostridium botulinum, Clostridium phytofermentans | C4ZEK2, Q8XHB3, Q0SPY4, Q0TM79, A7GE89, C1FNY3, B1KT07, B2UX86, B2THH3, A9KI94 | P31327 |
| 803 | GWKKNGWKT | Rhizobium loti, Rhizobium leguminosarum | Q985W1, Q1MKH6 | O60930 |
| 804 | GWKKNGWKTS | Rhizobium etli | Q2KBL2 | O60930 |
| 805 | GWLHTGDIG | Bacillus cereus | Q72YK9 | Q9ULC5 |
| 806 | GWYMGTEIG | Bacillus subtilis | O34453 | P29475 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 807 | GYEEAAAQG | Clostridium thermocellum, Desulfovibrio vulgaris, Desulfovibrio vulgaris | A3DHY7, A1VD34, Q72B11 | Q9Y2Z2 |
| 808 | GYGGPHAAFFA | Pseudomonas aeruginosa | Q9HTX7 | P23378 |
| 809 | GYGIRYEYG | Haemophilus influenzae | P45180 | P06737 |
| 810 | GYLGAGKTTLLN | Bacillus subtilis | P94400 | Q5RIA9 |
| 811 | GYLHIGHAK | Citrobacter koseri, Clostridium kluyveri, ptoclostridium difficile, Clostridium perfringens, Clostridium perfringens, Clostridium perfringens, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus ducreyi, Haemophilus influenzae, Haemophilus influenzae, Klebsiella pneumoniae, Klebsiella pneumoniae, Neisseria gonorrhoeae, Neisseria meningitidis, Neisseria meningitidis, Proteus mirabilis, Pseudomonas aeruginosa, Pseudomonas aeruginosa, Pseudomonas aeruginosa, Pseudomonas mendocina, Pseudomonas syringae, Pseudomonas putida, Pseudomonas stutzeri, Ralstonia solanacearum, Ralstonia pickettii | A8AJD6, A5N6Y3, Q188C8, Q8XMP3, Q0SVB1, Q0TTG1, C5BGA4, A4W846, B7NMN1, B6HYN9, P00962, B1IY48, B1X6L3, A7ZXU0, C4ZWF6, B7M5J8, B7L9L7, A7ZJ63, B7LKT3, B1LLC4, B7N9S6, Q1REN7, Q8FJW4, Q0TK03, A1A8U7, B7MPI5, B7MFU7, B7UKW1, B5YQM4, Q8X9H8, Q7VLM3, Q40K64, P43831, B5XZG7, A6T6C3, Q5F7G0, P57000, P56927, B4EV71, Q9I2U8, Q02KT5, B7VB85, A4XVG2, Q87YQ1, Q88IU5, A4VL72, Q8Y199, B2U846 | P07814 |
| 812 | GYLSDRFGR | Bacillus subtilis | O31762 | Q9Y694 |
| 813 | GYSVFAGVGERT REGND | Aeromonas hydrophila, Aeromonas salmonicida, Citrobacter koseri, Edwardsiella ictaluri, Enterobacter sp., Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus parasuis, Haemophilus somnus, Haemophilus ducreyi, Haemophilus influenzae, Haemophilus influenzae, Haemophilus influenzae, Haemophilus influenzae, Klebsiella pneumoniae, Klebsiella pneumoniae, Proteus mirabilis, Pseudomonas fluorescens, Pseudomonas putida, Pseudomonas syringae, Pseudomonas syringae, Pseudomonas savastanoi, Pseudomonas stutzeri, Pseudomonas putida, Pseudomonas fluorescens, Pseudomonas putida, Pseudomonas putida, Pseudomonas aeruginosa, Pseudomonas aeruginosa, Pseudomonas aeruginosa, | A0KQX8, A4STP3, A8ACN6, C5BF40, A4WGF5, A8A6J5, B1IX06, B7UMJ7, P0ABB4, B7LK77, B1LL59, A1AHR4, B1X9W0, C4ZZ10, B7NR34, B7NF48, B5YXD6, B7M588, Q1R4K2, B6I3W9, B7N2H1, Q0TAX7, P0ABB5, P0ABB6, B7MGF2, B7L882, A7ZTU4, B8F774, Q0I5X3, Q7VPP0, A5UA11, Q40N64, P43715, A5UGY9, B5XZM4, A6TG36, B4F0E7, C3K1E6, B1JFU1, Q4ZL24, Q87TT4, Q48BG5, A4VS62, B0KRA8, Q3K441, A5WBA3, Q88BX4, Q02DF4, A6VF32, Q9HT20, B7V791, Q4K3A9, Q1I2I7, A4Y187 | P06576 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Pseudomonas aeruginosa, Pseudomonas fluorescens, Pseudomonas entomophila, Pseudomonas mendocina | | |
| 814 | GYSVFAGVGERT REGNDLY | Helicobacter pylori, Helicobacter pylori, Helicobacter pylori, Helicobacter pylori, Helicobacter pylori, Helicobacter acinonychis | Q9ZK81, B6JMX2, B5Z8D0, P55988, Q1CSD5, Q17Y78 | P06576 |
| 815 | GYSVFAGVGERT REGNDLYHEM | Helicobacter hepaticus | Q7VJ21 | P06576 |
| 816 | GYTGEDGVE | Neisseria meningitidis, Neisseria meningitidis | Q9K0L8, Q9JVP2 | P48728 |
| 817 | GYTKDYPVE | Bacillus subtilis | P45867 | P45954 |
| 818 | HARGPVGLEGL | Pseudomonas fluorescens, Pseudomonas stutzeri, Pseudomonas aeruginosa, Pseudomonas fluorescens, Pseudomonas aeruginosa, Pseudomonas aeruginosa, Pseudomonas aeruginosa, Pseudomonas mendocina, Pseudomonas entomophila, Pseudomonas putida, Pseudomonas syringae, Pseudomonas putida, Pseudomonas syringae, Pseudomonas putida, Pseudomonas putida, Pseudomonas savastanoi, Ralstonia solanacearum, Ralstonia pickettii | Q4K5F9, A4VR07, B7V8A7, C3K2M9, Q02SH4, Q9HX20, A6V0A3, A4XYY4, Q1I4F0, B1J133, Q4ZN73, A5W9J6, Q87W6, Q88DL4, B0KJY5, Q48DL4, Q8XVT6, B2UC98 | P54886 |
| 819 | HDGPPYANG | Campylobacter fetus | A0RNK3 | Q9NSE4 |
| 820 | HDLGHGPFSH | Bacillus subtilis | P39651 | Q9Y3Z3 |
| 821 | HEIGHTLGL | Proteus mirabilis, Pseudomonas panacis, Pseudomonas aeruginosa | Q11137, A0A0C5CJR8, Q03023 | Q9H239 |
| 822 | HEWEKHGTC | Aeromonas hydrophila | Q07465 | O00584 |
| 823 | HFDRERIPERVVHA | Bacillus subtilis | P94377 | P04040 |
| 824 | HFPLVVWQTGSGTQ | Bacillus cereus, Bacillus anthracis, Listeria monocytogenes, Listeria innocua, Listeria monocytogenes, Rhizobium meliloti, Staphylococcus aureus, Staphylococcus aureus, Staphylococcus saprophyticus, Staphylococcus haemolyticus, Staphylococcus aureus, Staphylococcus aureus, Staphylococcus aureus, Staphylococcus aureus | Q81F85, Q81SA0, Q71XE0, Q929E8, Q8Y551, Q92PB6, Q6GFK5, Q5HE54, Q49YP8, Q4L7F5, Q8NW1, Q6G884, P64173, P64172 | P07954 |
| 825 | HFPLVVWQTGSGTQTNMNVNEVI | Pseudomonas aeruginosa | Q9I587 | P07954 |
| 826 | HFTSPIRRY | Escherichia coli, Haemophilus influenzae | P21499, P44907 | Q8TF46 |
| 827 | HGALYHSQS | Bacillus subtilis | P37941 | P21953 |
| 828 | HGATGKGNDQ | Rhizobium leguminosarum | Q1MEZ8 | P00966 |
| 829 | HGDGYPFDG | Tannerella forsythia | D0EM77 | P14780 |
| 830 | HGIPFYVAAP | Desulfitobacterium hafniense, Desulfitobacterium hafniense, Citrobacter koseri, Desulfovibrio alaskensis, Enterobacter sp., Geobacter lovleyi | B8FRM1, Q24UA0, A8ANI3, Q317L9, A4W7Z1, B3E3M5 | Q9BV20 |
| 831 | HGSDSVESA | Enterobacter sp., Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae | A4W096, B7MYF2, B7UGW4, B6I590, P0A764, B7LKC0, B7M7M2, A8A324, P0A763, B1IWE3, B7N6A6, B7LDB0, C4ZX93, B5Z0Y7, B1XAZ3, A7ZPW1, Q8FF53, Q1R8L4, B7MI03, B1LNH3, Q0TEW7, A1AE56, B7NRG8, B5XNL1, A6TCD7 | Q13232 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 832 | HGSTYGGNPL | Campylobacter jejuni, Escherichia coli, Escherichia coli, Escherichia coli, Rhizobium meliloti | Q9PIR7, Q8X4S6, P59317, P18335, Q92SA0 | P04181 |
| 833 | HGTAPDIAG | Streptococcus mutans | Q59940 | P50213 |
| 834 | HHPEWFNVY | Rhizobium leguminosarum, Rhizobium leguminosarum, Rhizobium etli | Q1MAM8, B5ZTF5, Q2K3A7 | P61457 |
| 835 | HHPEWFNVYNKV | Rhizobium sp., Rhizobium meliloti | C3MAI8, Q92L66 | P61457 |
| 836 | HHTFFEMLG | Bacillus halodurans, Bacillus licheniformis, Bacillus subtilis, Lactobacillus sakei, Bacillus cytotoxicus, Bacillus cereus, Bacillus cereus, Bacillus pumilus, Bacillus cereus, Bacillus thuringiensis, Bacillus weihenstephanensis, Bacillus anthracis, Bacillus thuringiensis, Bacillus clausii, Bacillus methylotrophicus, Desulfitobacterium hafniense, Fusobacterium nucleatum, Desulfovibrio alaskensis, Desulfovibrio vulgaris, Desulfovibrio vulgaris, Haemophilus influenzae, Listeria innocua, Listeria monocytogenes, Listeria welshimeri, Listeria monocytogenes, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus haemolyticus | Q9KDE6, Q65GS5, O34526, Q38YN9, A7GT67, Q817Z0, P61697, A8FFM9, Q634F6, A0RJ00, A9VI09, Q81LK0, Q6HDD7, Q5WHM8, A7Z735, Q24UT2, Q8RFJ8, Q30YS5, A1VEQ6, P61700, P43815, Q92BK9, Q71ZG6, A0AIV3, Q8Y722, Q49Y56, P67011, P67010, A5ITE3, A7X328, A6U287, Q8NW87, Q6G8V1, Q2YT60, A8Z4F6, A6QHF9, Q2FXV9, Q5HFE4, Q2FGA8, Q6GG85, Q8CSA7, Q5HNT2, Q4L6W5 | P49588 |
| 837 | HIDMDAFYA | Acinetobacter baylyi, Bacteroides fragilis, Clostridium perfringens, Clostridium perfringens, ptoclostridium difficile, Clostridium perfringens, Listeria monocytogenes, Listeria monocytogenes, Listeria monocytogenes, Listeria innocua, Listeria monocytogenes, Listeria welshimeri, Neisseria meningitidis, Neisseria meningitidis, Neisseria meningitidis, Neisseria gonorrhoeae, Rhizobium meliloti | Q6FFG4, Q64X95, Q8XK37, Q0SSQ2, Q18A91, Q0TQ38, Q71Y46, Q8Y5T0, C1KWR9, Q92A40, B8DBV7, A0AK80, Q9JY58, A1KUQ3, Q9JRG1, Q5F8N2, Q92XH8 | Q9UBT6 |
| 838 | HKMAEANRA | Propionibacterium acnes, Clostridium cellulolyticum, Corynebacterium glutamicum, Corynebacterium glutamicum, Corynebacterium urealyticum, Corynebacterium jeikeium, Corynebacterium kropnstedtii, Geobacter uraniireducens, Geobacter daltonii, Geobacter lovleyi, Geobacter bemidjiensis, Geobacter sp., Leuconostoc citreum, Leuconostoc mesenteroides, Rhizobium loti | Q6A6L4, B8I5N6, A4QBG8, Q8NT20, B1VES9, Q4JT38, C4LL65, A5GAY4, B9M6U9, B3E7T1, B5EFP6, C6E4R1, B1MW22, Q03ZQ3, Q98N60 | Q9Y2R9 |
| 839 | HLGHVFPDGP | Lactobacillus plantarum, Desulfovibrio vulgaris, Listeria monocytogenes, Listeria monocytogenes, Listeria monocytogenes, Listeria innocua, Listeria monocytogenes, Listeria | Q88W33, Q72EK2, C1KWF8, Q71YF7, Q8Y641, Q92AE9, B8DDP3, A0AJW4, P14930, Q9JWM8, | Q9Y3D2 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | welshimeri, Neisseria gonorrhoeae, Neisseria meningitidis, Neisseria meningitidis, Rhizobium meliloti | Q9K1N8, Q92Y46 | |
| 840 | HLGHVFPDGPGP | Bacillus licheniformis | Q65ID2 | Q9Y3D2 |
| 841 | HLGHVFPDGPGPNG | Bacillus clausii, Bacillus halodurans, Bacillus pumilus | Q5WH73, Q9KCX2, A8FEA3 | Q9Y3D2 |
| 842 | HLLGTHDFSAF | Bacillus clausii | Q5WLN0 | Q8NOZ8 |
| 843 | HMGITAENVA | Rhizobium meliloti | P50174 | Q9BWD1 |
| 844 | HNERLEFLGD | Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Haemophilus influenzae, Haemophilus influenzae, Klebsiella pneumoniae, Klebsiella pneumoniae, Proteus mirabilis, Ralstonia solanacearum, Ralstonia pickettii | C5B8Y2, A4WDD8, B7LUZ7, B7N6F5, Q1R8G6, B1LP80, A8A377, B6I5E1, P0A7Y0, B1IVR0, B1X1341, P0A7Y1, Q0TES1, A1AE97, C4ZYJ0, B7NRM0, B7M810, B7MYJ8, B5Z141, P0A7Y2, B7LDG0, A7ZQ11, B7MIQ2, B7UH07, Q4QPN0, A5UBC4, P44441, A5UFI8, A6TCI1, B5XNH0, B4F047, Q8Y0I1, B2U981 | Q9NRR4 |
| 845 | HNERLEFLGDA | Streptococcus thermophilus, Streptococcus thermophilus, Streptococcus thermophilus | Q5M3S3, Q5LZ68, Q03K17 | Q9NRR4 |
| 846 | HNERLEFLGDAV | Desulfovibrio vulgaris, Desulfovibrio vulgaris, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus haemolyticus, Staphylococcus carnosus, Staphylococcus saprophyticus, Streptococcus gordonii, Streptococcus agalactiae, Streptococcus agalactiae, Streptococcus agalactiae, Streptococcus equi, Streptococcus sanguinis, Streptococcus equi, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus uberis, Streptococcus pyogenes, Streptococcus pyogenes, Streptococcus pyogenes, Streptococcus pyogenes, Streptococcus pyogenes, | Q72C44, B8DPB3, Q2YXI3, Q931T1, A7X1J9, P66669, Q6G9Y0, A8Z3R9, Q6GHK2, A6QGD3, P66668, Q5HGJ9, A5ISB8, Q2FZ50, A6U152, Q2FHK5, Q8CPI1, Q5HPV8, Q4L5T5, B9DPJ2, Q49X17, A8AWC2, Q8E0K7, Q8E680, Q3K1Y2, C0MCR4, A3CP46, C0M8Y3, C10EK4, B2IPN5, C1C7M6, C1CR56, Q97QG6, Q8DPJ8, B5E4Y2, Q04K72, C1CKY7, B8ZJR8, B1IC43, B9DRH1, P0DF15, Q1J7V3, Q1JMX4, Q1JCZ9, P66672, P0DF14, P66670, Q48UR6, B5XKB7, A2RFW8, Q5XDA6, Q1JI19, Q8DT66 | Q9NRR4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus pyogenes,* | | |
| | | *Streptococcus pyogenes,* | | |
| | | *Streptococcus pyogenes,* | | |
| | | *Streptococcus pyogenes,* | | |
| | | *Streptococcus pyogenes,* | | |
| | | *Streptococcus pyogenes,* | | |
| | | *Streptococcus pyogenes,* | | |
| | | *Streptococcus mutans* | | |
| 847 | HNPTGIDPT | *Escherichia coli* | P00509 | P17174 |
| 848 | HPDIKAISFVGS | *Bacillus methylotrophicus, Bacillus clausii* | A7ZAI1, Q5WKZ1 | O02252 |
| 849 | HPDLRRILTDYGF | *Ralstonia solanacearum, Ralstonia pickettii, Stenotrophomonas maltophilia, Stenotrophomonas maltophilia* | Q8XXQ3, B2U7Q9, B2FNX7, B45QT4 | O75489 |
| 850 | HPDLRRILTDYGF EG | *Rhizobium meliloti* | O68854 | O75489 |
| 851 | HPDLRRILTDYGF EGHP | *Rhizobium etli, Rhizobium etli, Rhizobium leguminosarum, Rhizobium leguminosarum* | B3PVZ9, Q2K9T3, B5ZYL4, Q1MIL3 | Q75489 |
| 852 | HPDRNPDDP | *Desulfovibrio vulgaris, Desulfovibrio vulgaris* | A1V9Q3, Q725M6 | Q9UB54 |
| 853 | HPESYHSFM | *Haemophilus influenzae, Haemophilus influenzae, Haemophilus influenzae* | Q4QP46, P44538, A5UB10 | P46926 |
| 854 | HPFPGPGLA | *Helicobacter pylori* | B5Z842 | P49915 |
| 855 | HPHRGFETV | *Pseudomonas aeruginosa, Pseudomonas aeruginosa* | Q9HZ00, Q9I163 | O00625 |
| 856 | HPLAGQGVN | *Escherichia coli, Escherichia coli* | P75728, P25535 | Q9Y2Z9 |
| 857 | HQTGHNSGVIH | *Escherichia coli* | P37339 | Q9H9P8 |
| 858 | HRDIKPENIL | *Bifidobacterium longum* | Q8G4G1 | Q8IVW4 |
| 859 | HRDIKPGNIM | *Bifidobacterium longum* | Q8G6P9 | Q14164 |
| 860 | HRFAAYFQQG | *Klebsiella oxytoca* | P77877 | P06744 |
| 861 | HRGRLNVLA | *Bacillus subtilis, Bacillus licheniformis, Bacillus pumilus, Bacillus methylotrophicus* | P23129, Q65IH4, A8FE66, A7Z5J9 | Q9ULD0 |
| 862 | HRSHIDYLLL | *Haemophilus somnus, Haemophilus influenzae, Haemophilus influenzae, Haemophilus influenzae, Haemophilus influenzae, Pseudomonas fluorescens, Pseudomonas savastanoi, Pseudomonas fluorescens, Pseudomonas fluorescens, Pseudomonas syringae, Pseudomonas putida, Pseudomonas mendocina, Pseudomonas aeruginosa, Pseudomonas aeruginosa, Pseudomonas putida, Pseudomonas aeruginosa, Pseudomonas aeruginosa, Pseudomonas syringae, Pseudomonas entomophila, Pseudomonas putida, Pseudomonas putida* | Q0I2G8, A5UHQ2, Q4QMF0, A5UDX7, P44857, Q4KHJ1, Q48F46, Q3KHC9, C3K4R1, Q886Q7, B1JBS6, A4XWX9, A6V1B5, Q02RE5, B0KS79, Q9HXW7, B7V2U0, Q4ZWU3, Q1I610, Q88MQ0, A5W867 | Q9HCL2 |
| 863 | HRVQRVPKTE | *Haemophilus parasuis, Haemophilus influenzae, Haemophilus influenzae, Haemophilus somnus, Haemophilus ducreyi, Pseudomonas syringae* | B8F526, Q4QKS1, P43917, Q0I3135, Q7VMV9, Q888C1 | Q9UGC7 |
| 864 | HTGDSVVAP | *Staphylococcus carnosus* | B9DPN2 | P31327 |
| 865 | HTGRSRNDQV | *Desulfitobacterium hafniense, Desulfitobacterium hafniense* | Q24ZG7, B8FWX3 | P04424 |
| 866 | HTNFSTKAMRE | *Streptomyces viridochromogenes* | P19432 | P15104 |
| 867 | HTNGSQFFI | *Staphylococcus saprophyticus* | Q49W93 | P30414 |
| 868 | HTVCEEARCPNI | *Bacillus clausii* | Q5WDS6 | O43766 |
| 869 | HVRGGGELG | *Escherichia coli, Rhizobium sp., Rhizobium sp.* | P24555, P55656, P55627 | Q4J6C6 |
| 870 | HVSTGGGASLE | *Finegoldia magna* | B0S1H0 | P07205 |
| 871 | IAAGEVIQRPA | *Parabacteroides distasonis, Bacteroides thetaiotaomicron, Bacteroides fragilis, Bacteroides fragilis, Bacteroides vulgatus,* | A6LEJ8, Q8A120, Q5L8M5, Q64NX1, A6KXH3, B2RL29, Q7MX15 | P40692 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 872 | IAATNRPDVLD | *Porphyromonas gingivalis, Porphyromonas gingivalis, Haemophilus influenzae* | P45219 | Q9BVQ7 |
| 873 | IACGTSYHAG | *Acinetobacter baylyi, Bacillus licheniformis, Bacillus cereus, Bacillus thuringiensis, Bacillus anthracis, Bacillus cereus* | Q6F6U8, Q65P46, Q81J01, Q6HPL2, Q81VN5, Q73F49 | Q06210 |
| 874 | IADVGLVGFPN | *Clostridium phytofermentans* | A9KMF5 | A4D1E9 |
| 875 | IAHRLSTIQ | *Streptococcus pneumoniae* | P35598 | O95342 |
| 876 | IAHVDHGKSTL | *Stenotrophomonas maltophilia, Stenotrophomonas maltophilia* | B2FQC4, B4SRL3 | P13639 |
| 877 | IAREMNLSE | *Pseudomonas fluorescens* | Q51792 | P30039 |
| 878 | IAREMNLSET | *Pseudomonas chlororaphis* | Q51520 | P30039 |
| 879 | IATGHYART | *Geobacter uraniireducens* | A5GE36 | O75648 |
| 880 | IAVGSDADIV | *Ralstonia pickettii* | Q8VTT5 | Q14117 |
| 881 | IAVLTSGGDA | *Clostridium botulinum, Clostridium botulinum, Clostridium botulinum, Clostridium botulinum, Clostridium botulinum, Clostridium botulinum, Clostridium botulinum, Clostridium perfringens, Clostridium acetobutylicum, Haemophilus somnus, Staphylococcus carnosus, Streptococcus suis, Streptococcus sanguinis, Streptococcus pneumoniae, Streptococcus pneumoniae, Streptococcus pneumoniae, Streptococcus gordonii, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus agalactiae, Streptococcus agalactiae, Streptococcus agalactiae, Streptococcus equi, Streptococcus equi, Streptococcus equi, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus uberis* | B1L266, C3KV06, A5I798, A7GIW9, C1FM55, B1IFV9, A7FYW7, Q8XNH2, O08308, Q0I267, B9DN94, A4VTS0, A3CM69, B5E3Z8, B1IB66, C1C6M8, A8AXW1, C1CRZ7, C1CJY4, C1CDP4, Q97RC6, B8ZNU0, 62IP53, Q8DQ85, Q04L24, P65696, P65697, Q3K1E6, C0M8V6, B4U2M2, C0MGJ9, P0DD03, P0DD02, 65XLV6, A2RE65, Q1JGH6, Q48T86, Q1JLD9, Q8P056, Q1J6F7, Q5X6V2, Q99ZD0, B9DSA4 | P08237 |
| 882 | ICPVGALTS | *Streptomyces coelicolor* | Q9XAR0 | P28331 |
| 883 | IDGLIVTNTT | *Acinetobacter baylyi, Acinetobacter baumannii, Acinetobacter baumannii, Acinetobacter baumannii, Acinetobacter baumannii, Acinetobacter baumannii, Acinetobacter baumannii* | Q6FCL9, B7GZW7, A3M6Y2, 67I2L5, B2HUT6, B0V824, B0VKB8 | Q02127 |
| 884 | IDLAIDGADEVD | *Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus* | Q8CRC8, Q5HLQ9, Q5HDM1, Q6GE99, P66696, Q6G6Y5, P66694, P66695 | P49247 |
| 885 | IDLIIPRGS | *Clostridium thermocellum, Clostridium cellulolyticum* | A3DC22, B8I6T0 | P54886 |
| 886 | IDQLKPGGRL | *Geobacter sulfurreducens* | Q74CZ5 | P22061 |
| 887 | IDTCQGDSGGP | *Streptomyces glaucescens* | Q54179 | P10323 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 888 | IDTGMGLER | Lactobacillus johnsonii, Lactobacillus gasseri, Lactobacillus acidophilus, Lactobacillus helveticus, Lactobacillus brevis, Lactobacillus salivarius, Clostridium perfringens, Clostridium perfringens, Clostridium perfringens, Clostridium acetobutylicum, Enterococcus faecalis, Pediococcus ntosaceus | P61702, Q045P6, Q5FLW6, A8YTJ0, Q03R43, Q1WT32, Q0TPH4, Q0SS42, Q8XJH6, Q97IG3, Q835J8, Q03ER8 | P49588 |
| 889 | IDTGMGLERLV | Lactobacillus casei | Q03B02 | P49588 |
| 890 | IDTPGHVDFT | Clostridium tetani, Clostridium phytofermentans, Corynebacterium urealyticum | Q890N8, A9KRZ3, B1VET0 | Q96RP9 |
| 891 | IDTPGHVDFTIEVER | Campylobacter jejuni, Campylobacter jejuni, Campylobacter jejuni, Campylobacter jejuni, Campylobacter fetus, Campylobacter jejuni, Campylobacter hominis, Campylobacter lari, Campylobacter concisus, Campylobacter curvus, Helicobacter pylori, Helicobacter pylori, Helicobacter pylori, Helicobacter acinonychis, Helicobacter pylori, Helicobacter pylori, Helicobacter pylori, Helicobacter hepaticus | A7H4P5, Q5HVX6, Q9PI16, A8FKR7, A0RQI0, A1VYJ8, A7I3T6, B9KFH1, A8Z6I6, A7GZJ4, Q9ZK24, P56002, B2UUV6, Q17VN9, B5Z8J0, Q1CS71, B6JN34, Q7VJ85 | Q96RP9 |
| 892 | IDVWEHAYYL | Bacillus cereus, Bacillus anthracis | Q814I6, Q81JK8 | P04179 |
| 893 | IEAHGTGTK | Bacillus subtilis | Q9R9J1 | P49327 |
| 894 | IFITHLHGDH | Bacillus clausii, Bacillus halodurans | Q5WGC3, Q9KC61 | Q9H777 |
| 895 | IFLRELISNASDA | Geobacter sulfurreducens | P61185 | P14625 |
| 896 | IGGADMPW | Escherichia coli, Escherichia coli, Escherichia coli, Haemophilus influenzae | P0AB69, P0AB67, P0AB68, P43010 | Q13423 |
| 897 | IGGDGSLTGA | Bacteroides thetaiotaomicron, Bacteroides thetaiotaomicron | Q8A624, Q8A8R5 | Q01813 |
| 898 | IGGGMAYTFLK | Bifidobacterium adolescentis, Streptomyces griseus, Streptomyces coelicolor, Streptomyces avermitilis | A1A1N3, B1W0Z3, Q9Z519, Q829W2 | P07205 |
| 899 | IGIAMGSGT | Escherichia coli | P37617 | Q14983 |
| 900 | IGIGGSDLGP | Neisseria meningitidis, Neisseria gonorrhoeae, Neisseria meningitidis | Q9JSS6, Q5F694, Q9K153 | P06744 |
| 901 | IGKAGRNRW | Streptococcus agalactiae, Streptococcus agalactiae, Streptococcus agalactiae | Q8E2C8, Q8E7T5, Q3K3W6 | Q5T653 |
| 902 | IGKAGRNRWLGKRP | Desulfovibrio maeticus | C4XLX6 | Q5T653 |
| 903 | IGKGFQGVMKRWGFKG | Geobacter uraniireducens | A5GAW5 | P09001 |
| 904 | IGLAVMGQNLILNMND | Haemophilus ducreyi | Q7VMX4 | P52209 |
| 905 | IGLAVMGQNLILNMNDHGF | Aggregatibacter actinomycetemcomitans, Haemophilus influenzae | P70718, P43774 | P52209 |
| 906 | IGMPHRGRLN | Corynebacterium glutamicum | Q8NRC3 | Q96HY7 |
| 907 | IGSGGREHT | Bacillus halodurans | Q9KF52 | P22102 |
| 908 | IGSGPGGYVAAI | Rhizobium etli | O05940 | P09622 |
| 909 | IGSPPGYVG | Clostridium acetobutylicum | Q97KG0 | Q9H078 |
| 910 | IGSPPGYVGHEE | Bacillus subtilis | O31673 | Q9H078 |
| 911 | IGVLTSGGD | Bacillus halodurans, Bacillus clausii, Bacillus licheniformis, Bacillus pumilus, Bacillus subtilis, Bacillus cereus, Bacillus cereus, Bacillus thuringiensis, Bacillus cereus, Bacillus cereus, Bacillus cereus, Bacillus cereus, Bacillus cereus, Bacillus anthracis, Bacillus thuringiensis, Bacillus cereus, Bacillus anthracis, Bacillus anthracis, Bacillus methylotrophicus, Bacillus weihenstephanensis, Bacillus cereus, Bacillus cereus, Bacillus cereus, Bacillus cytotoxicus, Streptomyces coelicolor | Q9K843, Q5WEF6, Q65G82, A8FG55, O34529, Q4MVY3, B9J099, Q6HCT3, Q72ZD8, Q633J8, B7HRN9, C1EUU3, Q81KZ0, A0RJJ6, B7JRX2, C3L8X8, C3PAI8, A7Z7K6, A9VJR1, B7HFB3, B7IJZ8, Q817F3, A7GTP4, Q9FC99 | Q01813 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 912 | IGVLTSGGDA | Citrobacter koseri, Edwardsiella ictaluri, Enterobacter sp., Enterobacter cloacae, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Klebsiella pneumoniae, Klebsiella pneumoniae | A8AL13, C5BC26, A4WG81, Q9Z6C3, P0A796, A8A720, Q0TAE8, B6I4Q8, B1LNL9, B7N2Q7, B7NFL3, A7ZUC9, B1IVG3, B1X1382, B7NU91, B5YZ53, B7LA13, C5A083, B7M6W7, P0A797, B7MI48, B7LVC9, Q8FBD0, B7UNN6, B5XZ40, A6TGB8 | Q01813 |
| 913 | IHARGPVGLEGL | Acinetobacter baylyi, Acinetobacter baumannii, Acinetobacter baumannii, Acinetobacter baumannii, Acinetobacter baumannii, Acinetobacter baumannii, Acinetobacter baumannii | Q6FEN5, B0VKT1, B2I3D3, B0V4S6, B7H081, B7I5F5, A3M1Z8 | P54886 |
| 914 | IHDAVRPFV | Rhizobium loti | Q98MX9 | A4D126 |
| 915 | IHDAVRPFVE | Bifidobacterium longum, Bifidobacterium longum, Bifidobacterium longum | B7GMX1, Q8G7E2, B3DTQ9 | A4D126 |
| 916 | IHGSDSVESA | Staphylococcus haemolyticus, Staphylococcus saprophyticus, Staphylococcus carnosus | Q4L6H1, Q49XS3, B9DNV3 | Q13232 |
| 917 | IIEPTSGNTGIGLA | Bacillus subtilis, Streptococcus pyogenes | O34476, Q5XAQ3 | P35520 |
| 918 | IIFTSGGTE | Bacillus subtilis | O34599 | Q96I15 |
| 919 | IIGGGMAFTFLK | Geobacter metallireducens, Geobacter sp., Geobacter bemidjiensis, Geobacter uraniireducens, Geobacter daltonii | Q39U98, C6E770, B5EF40, A5G382, B9M2C3 | P00558 |
| 920 | IILDEPTAG | Bacillus cereus, Bacillus anthracis | Q81CT8, Q81PZ8 | Q9BZC7 |
| 921 | IILLDEATSALD | Lactobacillus plantarum | Q88YK7 | Q9NP58 |
| 922 | IIPWNFPLLM | Pseudomonas fluorescens | O06837 | O94788 |
| 923 | IITGPNMGGKST | Acinetobacter baumannii, Acinetobacter baumannii, Acinetobacter baumannii, Acinetobacter baumannii, Acinetobacter baumannii, Acinetobacter baylyi | B0VAU7, B2HX50, B7IBV9, B7GW85, B0VUC9, Q6FC54 | P43246 |
| 924 | IITGPNMGGKSTY | Aeromonas salmonicida, Aeromonas hydrophila, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Haemophilus somnus, Klebsiella pneumoniae, Klebsiella pneumoniae, Proteus mirabilis, Pseudomonas syringae, Pseudomonas entomophila, Pseudomonas putida, Pseudomonas putida, Pseudomonas putida, Pseudomonas putida | A4SIL2, A0KPG5, A8ANU8, A4WDU5, B1LQ55, B7NT79, B6I6B9, Q8FEL3, A7ZQH3, B7MYN6, Q0TEC9, Q1R7W4, A1AES5, B7MKK5, B7LWH8, B7N6W4, B7LEE7, B7LXE0, B5Z397, Q9S6P8, B7UHE9, P23909, B1IUU6, A8A3L2, B1XCR0, C4ZZN7, Q4QML2, A5UE20, Q0I1B8, B5XV49, A6TD24, B4F220, Q87XW6, Q1I659, A5W816, B1JB25, Q88ME7, B0KSD2 | P43246 |
| 925 | IIYTSGTTG | Bacillus weihenstephanensis, Bacillus cereus, Bacillus cereus, Bacillus thuringiensis, Bacillus cereus, Bacillus cereus, Bacillus anthracis, Bacillus anthracis, Bacillus anthracis, Bacillus thuringiensis, Bacillus cereus, Bacillus | A9VM74, B7JDD6, B9J2F2, Q6HC29, B7HTW3, Q81611, C3LB87, C3PCK3, Q81K97, A0RK73, Q63215, A7GU88, | Q4G176 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | cytotoxicus, Bacillus subtilis, Haemophilus influenzae | P39845, P44446 | |
| 926 | IIYTSGTTGRPKGV | Bacillus subtilis | P27206 | Q4G176 |
| 927 | IKAISFVGS | Bacillus subtilis, Bacillus subtilis, Bacillus licheniformis | A7BJC4, P42412, Q65D00 | O02252 |
| 928 | IKEGDIVKRTG | Clostridium perfringens, Clostridium perfringens, Clostridium perfringens, ptoclostridium difficile | Q0S0Z3, Q8XID2, Q0TNC2, Q180W8 | P25705 |
| 929 | IKKAYRKLA | Desulfitobacterium hafniense, Desulfitobacterium hafniense, ptoclostridium difficile, Corynebacterium glutamicum, Streptomyces avermitilis | Q24SS4, B8FUN3, Q182E7, Q8NLY8, Q82EX7 | Q8NHS0 |
| 930 | IKKAYRKMALKYHPD | Campylobacter lari, Campylobacter jejuni, Campylobacter jejuni, Campylobacter jejuni, Campylobacter jejuni, Campylobacter jejuni, Helicobacter hepaticus | B9KFK6, Q5HTK3, A7H2C0, Q85213, A8FMW6, A1WOP5, Q7VG06 | O75953 |
| 931 | IKKAYRRKA | Propionibacterium acnes | Q6A997 | P25686 |
| 932 | IKPGAIVID | Listeria innocua, Listeria monocytogenes, Listeria monocytogenes, Listeria welshimeri | Q92BZ4, B8DFW8, Q8Y7C5, A0A1G1 | P11586 |
| 933 | IKPGSMGKP | Bacillus subtilis, Bacillus subtilis | C0SPB0, P39062 | Q53FZ2 |
| 934 | IKVGIGPGS | Helicobacter pylori | P56088 | Q9P2T1 |
| 935 | IKWNFTKFL | Neisseria meningitidis, Neisseria meningitidis, Neisseria meningitidis, Neisseria meningitidis | A1KV41, P0A0T4, P0A0T5, P0C2T0 | P36969 |
| 936 | IKWNFTKFLID | Bacillus halodurans | Q9Z9N7 | P36969 |
| 937 | ILCFYGPPGVGKTS | Helicobacter pylori, Helicobacter pylori | Q9ZJL3, P55995 | P36776 |
| 938 | ILFIDEIHR | Helicobacter acinonychis, Helicobacter pylori, Helicobacter pylori, Helicobacter pylori, Helicobacter pylori, Helicobacter pylori | Q17WP7, B2USM3, Q9ZM57, B5ZAF5, B6JKW4, Q1CUB7, O25699 | Q96S55 |
| 939 | ILFSAHSLP | Geobacter metallireducens | Q39ZQ5 | P22830 |
| 940 | ILGHVQRGG | Streptomyces coelicolor | Q9L1L8 | Q01813 |
| 941 | ILGQDPYHG | ptoclostridium difficile, Ralstonia solanacearum | Q182G9, Q8XVE4 | P13051 |
| 942 | ILGQDPYHGP | Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus uberis, Streptococcus equi, Streptococcus equi, Streptococcus pyogenes, Streptococcus pyogenes, Streptococcus pyogenes, Streptococcus equi, Streptococcus pyogenes | B5XL20, Q48U05, A2RFO0, Q1JHA5, Q1JC76, Q1JM60, Q9A072, Q1J724, B9DSB9, B4U3D4, C0M7J9, Q8P1B6, P0DG75, P0DG74, C0ME57, Q5XCK3 | P13051 |
| 943 | ILILDEATS | Lactobacillus plantarum, Bacillus cereus, Bacillus cereus, Bacillus thuringiensis, Bacillus thuringiensis, Bacillus anthracis, Bacillus cereus, Streptococcus thermophilus, Streptococcus thermophilus, Streptococcus thermophilus, Streptococcus pneumoniae, Streptococcus pneumoniae, Streptococcus pneumoniae | Q88XV2, Q81J16, Q73F67, Q6HPN0, A0R8K8, Q81VQ2, Q63H62, Q03182, Q5M243, Q5LXJ3, Q8DMX9, Q97N50, Q04HV7 | Q2M3G0 |
| 944 | ILITGGAGF | Escherichia coli | P27830 | Q8NBZ7 |
| 945 | ILVDYSKNL | Aeromonas salmonicida, Aeromonas hydrophila | A4STE1, A0KEM2 | P06744 |
| 946 | ILVFDLGGGTFDVSLL | Corynebacterium diphtheriae | Q6NEY9 | P11021 |
| 947 | ILVHGDAAF | Bacillus cereus, Bacillus cereus, Bacillus cereus, Bacillus cereus, Bacillus cereus, Bacillus cereus, | C1ELG5, B7HH19, B9IU58, B7I0H2, Q81GF2, B7JEU9, | Q9ULD0 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Bacillus anthracis, Bacillus anthracis, Bacillus anthracis, Bacillus cereus, Bacillus cereus, Bacillus thuringiensis, Bacillus cereus, Bacillus cytotoxicus, Bacillus weihenstephanensis* | Q81TK1, C3LAU3, C3P487, B7IM94, Q63EB1, Q6HL58, Q73BN8, A7GMD4, A9VJX9 | |
| 948 | ILYTSGTTG | *Bacillus subtilis* | O07610 | Q9H6R3 |
| 949 | IMIHQPSGGA | *Bacillus halodurans* | Q9K888 | Q16740 |
| 950 | IMITPICPHSL | *Clostridium phytofermentans* | A9KMB6 | Q95544 |
| 951 | IMVARGDLG | *Corynebacterium efficiens, Haemophilus influenzae* | Q8FP04, P43924 | P30613 |
| 952 | IMVGPGTGIAPF | *Bacillus subtilis* | O08336 | Q9UBK8 |
| 953 | IMVGPGTGVAPF | *Bacillus megaterium* | P14779 | P16435 |
| 954 | INGFGRIGR | *Bacillus subtilis, Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Helicobacter pylori, Helicobacter pylori, Klebsiella pneumoniae, Klebsiella pneumoniae, Klebsiella pneumoniae, Proteus mirabilis, Pseudomonas aeruginosa, Streptomyces aureofaciens* | Q34425, A8APE1, C5BAU7, A4WE72, Q1R7A6, B7MZM0, B7UHW9, B1LDD2, B6I761, B7N7H3, P0A9B6, Q0TDS9, B1IT76, P0A9B7, B5YQB9, A8A467, B1XEL0, C5A0J7, B7LYU4, P0A9B8, B7LFI3, A7ZR35, B7LPD5, B7NHY6, A1AFB1, B7MMA9, Q9ZKT0, P55971, P24164, A6TDT2, B5XUB7, B4EUH7, P27726, Q59800 | O14556 |
| 955 | INGFGRIGRL | *Clostridium pasteurianum, Clostridium acetobutylicum, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis* | Q59309, O52631, P0A038, Q6GB58, P0A037, Q5HHP5, Q6GIL8, P99136, P0A036, Q8CPY5, Q5HQV4 | O14556 |
| 956 | INIIDTPGHVDFT | *Lactobacillus fermentum, Lactobacillus brevis, Lactobacillus reuteri, Lactobacillus reuteri, Lactobacillus plantarum, Lactobacillus salivarius, Fusobacterium nucleatum, Desulfitobacterium hafniense, Desulfitobacterium hafniense, Propionibacterium acnes, ptoclostridium difficile, Clostridium acetobutylicum, Clostridium novyi, Clostridium thermocellum, Clostridium kluyveri, Clostridium kluyveri, Corynebacterium efficiens, Corynebacterium aurimucosum, Finegoldia magna, Kocuria rhizophila, Micrococcus luteus, Streptomyces avermitilis, Streptomyces coelicolor, Streptomyces griseus* | B2GDX1, Q03PV4, B2G8Y0, A5VLK8, Q88XY8, Q1WVA0, Q8R602, Q250N5, B8G1W3, Q6A6L5, Q18CF4, Q97EH4, A0PXU3, A3DIZ9, B9DYA6, A5N4P4, Q8F585, C3PKP1, B050I4, B2GIL1, C5CC67, Q82DQ1, P40173, B1W417 | Q96RP9 |
| 957 | INIIDTPGHVDFTIEVER | *Lactobacillus delbrueckii, Lactobacillus delbrueckii, Lactobacillus johnsonii, Lactobacillus gasseri, Lactobacillus helveticus, Lactobacillus acidophilus, Corynebacterium jeikeium, Geobacter metallireducens, Geobacter bemidjiensis, Geobacter lovleyi, Sphingomonas wittichii* | Q1GBM0, Q04C17, Q74L90, Q046C7, A8YXK3, Q5FM92, Q4JT40, Q39Y09, B5EFP7, B3E7T2, A5V6O5 | Q96RP9 |
| 958 | INIIDTPGHVDFTIEVERALR | *Desulfovibrio alaskensis* | Q30Z38 | Q96RP9 |
| 959 | INNAAGNFI | *Bacillus subtilis* | O34717 | Q16698 |
| 960 | INSAVFPGLQGGP | *Methylobacterium sp.* | B0UML5 | P34896 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 961 | IPDYRGPNG | *Streptomyces coelicolor* | Q8CJM9 | Q9NRC8 |
| 962 | IPHNGCRPRK | *Methylobacterium extorquens, Methylobacterium radiotolerans, Methylobacterium extorquens, Methylobacterium populi* | A9W4R7, B1LWQ1, B7L0S7, B1Z770 | P82912 |
| 963 | IPPPNVTGSLH | *Acinetobacter baylyi, Escherichia coli, Escherichia coli, Escherichia coli, Haemophilus influenzae, Haemophilus influenzae, Haemophilus influenzae, Haemophilus influenzae, Haemophilus ducreyi, Pseudomonas aeruginosa, Pseudomonas savastanoi, Pseudomonas syringae, Pseudomonas syringae, Pseudomonas fluorescens, Pseudomonas putida, Rhizobium loti, Rhizobium meliloti, Sphingomonas wittichii* | Q6F8F0, Q8XCB3, Q8FAD1, P07118, A5UEN9, P43834, A5UBZ9, Q4QKA4, Q7VN93, Q9HXH0, Q48MF2, Q887M3, Q4ZXI0, Q4KHT9, Q88P76, Q98LB1, Q92037, A5V592 | P26640 |
| 964 | IPPPNVTGSLHLGHA | *Streptomyces coelicolor, Streptomyces avermitilis* | O06851, Q82CA3 | P26640 |
| 965 | IPVIANGDI | *Haemophilus influenzae* | P44965 | O95620 |
| 966 | IQFKLADMA | *Bacillus subtilis* | O34421 | P16219 |
| 967 | IQNALGSDI | *Bacillus cytotoxicus, Bacillus weihenstephanensis, Bacillus cereus, Bacillus cereus, Bacillus cereus, Bacillus cereus, Bacillus cereus, Bacillus thuringiensis, Bacillus cereus, Bacillus cereus, Bacillus thuringiensis, Bacillus cereus, Bacillus cereus, Bacillus anthracis, Bacillus anthracis, Bacillus anthracis, Bacillus cereus, Bacillus halodurans* | A7GT99, A9VIP3, B7HE51, Q817W6, B7IIS9, Q634C7, Q6HDA9, C1ESW1, B7HQH6, A0RJ24, Q73064, B7JQ03, Q81LH2, C3L6U6, C3P9A4, B9IYZ1, Q9KDI5 | Q9BXR0 |
| 968 | IQVYEETSG | *Clostridium perfringens, Clostridium perfringens, Clostridium perfringens, Clostridium tetani, Clostridium botulinum, Clostridium botulinum, ptoclostridium difficile, Enterococcus hirae, Streptococcus gordonii, Streptococcus sanguinis, Streptococcus pyogenes, Streptococcus pyogenes, Streptococcus pneumoniae, Streptococcus pneumoniae, Streptococcus pneumoniae, Streptococcus pneumoniae, Streptococcus pneumoniae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes* | Q8XJW5, Q0TPW7, Q0SSI2, Q896K4, B2UWY4, B2TP91, Q184E7, Q08636, A8AUJ7, A3CK48, Q1JNS8, Q1JDX0, B1ICC9, B5E552, B8ZK31, C10ES2, Q97QA8, A2RC97, Q5XE50, Q1J8S5, Q9A1Q3, Q1JIX5, Q48VL3, P0DA06, P0DA07, Q8P2U6, B5XJH3 | P38606 |
| 969 | IRGHRRTYVGS | *ptoclostridium difficile* | Q180E4 | Q86WA8 |
| 970 | IRNFSIVAH | *Lactobacillus brevis, Lactobacillus plantarum, Lactobacillus fermentum, Lactobacillus reuteri, Lactobacillus reuteri, Methylobacterium sp., Methylobacterium nodulans, Clostridium botulinum, Clostridium botulinum, Clostridium botulinum, Clostridium botulinum, Clostridium botulinum, Clostridium botulinum, Clostridium botulinum, Clostridium botulinum, Clostridium perfringens, Clostridium perfringens, Clostridium perfringens, Clostridium kluyveri, Rhizobium etli, Rhizobium leguminosarum, Rhizobium* | Q03QU8, Q88VN0, B2GBR9, B2G6W5, A5VJE9, B0UFE0, B8IMT0, A5I644, A7FXL9, B1KZP1, A7GH10, B1ILM7, C1FVU4, C3L3H1, Q0SRD8, Q8XIS6, Q0TNS2, A5N6L8, Q2KDL5, B5ZXQ5, Q1MMQ8, B3PYC6, Q92SU3, Q98DV1 | Q8N442 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | leguminosarum, Rhizobium etli, Rhizobium meliloti, Rhizobium loti | | |
| 971 | IRPRGGDFLY | Parabacteroides distasonis | A6L8P3 | Q9NTM9 |
| 972 | IRPRGGDFLYS | Bacteroides fragilis, Bacteroides fragilis, Bacteroides thetaiotaomicron | Q5L9Y1, Q64Q87, Q89ZG1 | Q9NTM9 |
| 973 | IRTVMITGD | Bacillus cereus, Listeria monocytogenes | Q73E41, Q8Y805 | Q4VNC0 |
| 974 | IRTVMITGDN | Rhizobium loti | Q98GX6 | Q4VNC1 |
| 975 | IRTVMVTGD | Pseudomonas aeruginosa, Rhizobium meliloti | P57698, Q92XJ0 | Q9H7F0 |
| 976 | IRTYNFPQNRVTDHRI | Bacillus licheniformis, Bacillus subtilis, Bacillus weihenstephanensis, Bacillus cytotoxicus, Lactobacillus plantarum, Bacillus cereus, Bacillus thuringiensis, Bacillus cereus, Bacillus cereus, Bacillus cereus, Bacillus anthracis | Q65DV1, P45872, A9VSC7, A7GV79, Q88UT2, Q812I4, Q6HAV4, Q630R9, Q72XC2, B9IRW2, Q81JX1 | Q9UGC7 |
| 977 | ISGAHLNPA | Bacillus subtilis | P18156 | P29972 |
| 978 | ISGAHLNPAV | Pseudomonas aeruginosa | Q9HWZ3 | P29972 |
| 979 | ISGGHFNPAV | Escherichia coli, Escherichia coli, Escherichia coli | P60845, P60844, Q8X6K6 | O94778 |
| 980 | ISGGHFNPAVS | Rhizobium meliloti | Q92NM3 | O94778 |
| 981 | ISGGHFNPAVSL | Rhizobium meliloti | Q92ZW9 | O94778 |
| 982 | ISRQLWWGH | Lactobacillus sakei, Enterococcus faecalis, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus, Staphylococcus epidermidis, Staphylococcus epidermidis, Staphylococcus saprophyticus, Streptococcus agalactiae, Streptococcus agalactiae, Streptococcus pyogenes, Streptococcus pyogenes, Streptococcus pyogenes, Streptococcus thermophilus, Streptococcus pyogenes, Streptococcus pyogenes, Streptococcus pneumoniae, Streptococcus pyogenes, Streptococcus pneumoniae, Streptococcus thermophilus, Streptococcus mutans, Streptococcus agalactiae | Q38XD1, Q82ZW6, B9DND4, Q6GG42, Q7A0P4, A8Z2I4, Q6G8R2, Q99TJ8, A6QHJ8, Q5HFA8, Q2FG72, A5ITI8, Q2FXR8, A6U2D1, Q2YTA0, Q931Q1, A7X383, Q4L703, Q5HNN9, Q8CS83, Q49Y96, Q3K2S4, Q8E1B5, Q99YS1, Q8P040, Q4S5A4, Q5M5J8, P0DG65, P0DG64, Q97S45, Q5XAW8, Q8DOU7, Q5M111, Q8DSL1, Q8E650 | P26640 |
| 983 | ISRQLWWGHRIPA | Lactobacillus plantarum, Lactobacillus johnsonii, Lactobacillus acidophilus | Q88UX7, Q74JZ8, Q5FKW5 | P26640 |
| 984 | ITAQNHGYA | Clostridium acetobutylicum | Q97FT2 | P31327 |
| 985 | ITEIYEGTSE | Clostridium acetobutylicum | P52042 | P16219 |
| 986 | ITEIYEGTSEI | Clostridium propionicum | G3KIM8 | P16219 |
| 987 | ITGASSGIG | Listeria monocytogenes, Staphylococcus haemolyticus | P25145, Q4L8Y1 | P56937 |
| 988 | ITGASSGIGL | Bacillus subtilis, Helicobacter pylori | O32291, O05730 | P56937 |
| 989 | ITGPNMGGKST | Ralstonia pickettii, Ralstonia solanacearum | B2U9E4, Q8Y093 | P43246 |
| 990 | ITGPNMGGKSTY | Bacillus clausii, Edwardsiella ictaluri, Haemophilus influenzae, Pseudomonas aeruginosa, Pseudomonas aeruginosa, Pseudomonas aeruginosa, Pseudomonas aeruginosa, | Q5WFY3, C5BGI4, P44834, Q9HY08, A6V1G8, B7V8C8, Q02R92, A4VJN9, Q48F92, Q4ZWP5, Q4KHE3, Q3KH79, | P43246 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
|  |  | *Pseudomonas stutzeri, Pseudomonas savastanoi, Pseudomonas syringae, Pseudomonas fluorescens, Pseudomonas fluorescens, Pseudomonas fluorescens* | C3KCT2 |  |
| 991 | ITGPNMSGKSTY | *Lactobacillus johnsonii, Lactobacillus fermentum, Lactobacillus salivarius, Lactobacillus casei, Lactobacillus casei, Lactobacillus delbrueckii, Lactobacillus acidophilus, Lactobacillus brevis, Lactobacillus helveticus, Lactobacillus delbrueckii, Lactobacillus sakei, Listeria innocua, Listeria welshimeri, Listeria monocytogenes, Listeria monocytogenes, Listeria monocytogenes, Pediococcus ntosaceus, Staphylococcus carnosus, Streptococcus gordonii, Streptococcus suis, Streptococcus pneumoniae, Streptococcus pyogenes, Streptococcus pyogenes, Streptococcus pyogenes, Streptococcus pyogenes, Streptococcus agalactiae, Streptococcus pyogenes, Streptococcus pyogenes, Streptococcus agalactiae, Streptococcus agalactiae, Streptococcus pyogenes, Streptococcus sanguinis, Streptococcus pyogenes, Streptococcus pyogenes, Streptococcus pyogenes, Streptococcus pyogenes, Streptococcus pneumoniae, Streptococcus mutans, Streptococcus uberis, Streptococcus thermophilus, Streptococcus thermophilus, Streptococcus equi, Streptococcus thermophilus, Streptococcus equi* | P61668, B2GB17, Q1WT15, B3W9W4, Q035Z2, Q048Y4, Q5FLX5, Q03R33, A8YTH9, Q1G938, Q38YR4, Q92BV3, A0AIK5, B8DFS4, C1L2V9, Q8Y789, Q71ZR7, Q03EQ7, B9DPB9, A8AZU4, A4W4J7, C1CTY2, Q1JEH0, Q8NZ24, A2RGX2, Q5X9F3, Q3JYM3, B5XJ75, Q1JJH0, Q1J9C1, Q8DWW1, Q8E2R3, Q48QT6, A3CR17, Q1J489, P0DC61, P0DC60, Q99XL8, B5E385, Q8DRW8, B9DW73, Q03MY4, Q5M1Z0, COMGC5, Q5M6I1, C0MAS5 | Q15457 |
| 992 | ITKELIEIISGA | *Methylobacterium sp., Methylobacterium extorquens, Methylobacterium populi, Methylobacterium extorquens, Methylobacterium nodulans, Rhizobium sp., Rhizobium loti, Rhizobium leguminosarum, Rhizobium meliloti, Rhizobium etli, Rhizobium leguminosarum* | B0UE40, A9W2R2, B1ZEE8, B7KUA3, B8IN02, C3M952, Q98EV7, B5ZSN8, Q92LK7, B3PQ69, Q1MAZ1 | P36542 |
| 993 | ITPTPLGEGK | *Aeromonas salmonicida, Aeromonas hydrophila* | A4SPE5, A0KIN9 | P11586 |
| 994 | ITPTPLGEGKSTTT IGLVQ | *Desulfovibrio desulfuricans* | B8J0C2 | P11586 |
| 995 | ITPVPGGVG | *Clostridium tetani, Geobacter metallireducens, Geobacter sulfurreducens* | Q894G6, Q39Z32, Q74GN1 | P13995 |
| 996 | ITPVPGGVGP | *Lactobacillus gasseri, Lactobacillus johnsonii, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus,* | Q044I0, Q74IM0, Q8CPP4, Q5HQA7, Q4L572, Q6GAF0, A8Z1K5, A6QF52, Q2FI15, Q8NX95, Q5HH21, Q2FZJ6, Q99V34, Q7A697, A7X0V3, A5IRV0, A6U0N1 | Q9H903 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 997 | ITPVPGGVGPMT | *Staphylococcus aureus, Staphylococcus aureus, Staphylococcus aureus, Acinetobacter baylyi, Akkermansia muciniphila, Bacillus pumilus, Bacillus licheniformis, Lactobacillus salivarius, Eubacterium rectale, Bacteroides fragilis, Bacteroides fragilis, Bacteroides thetaiotaomicron, Campylobacter concisus, Campylobacter fetus, Clostridium thermocellum, Desulfovibrio desulfuricans, Desulfovibrio vulgaris, Desulfovibrio vulgaris, Geobacter daltonii, Geobacter uraniireducens, Geobacter metallireducens, Geobacter sulfurreducens, Helicobacter hepaticus, Pseudomonas mendocina, Pseudomonas mendocina, Pseudomonas savastanoi, Pseudomonas putida, Ralstonia solanacearum, Rhizobium etli, Rhizobium etli, Rhizobium meliloti, Rhizobium loti, Rhizobium leguminosarum, Rhizobium leguminosarum, Rhizobium meliloti, Sphingomonas wittichii, Staphylococcus saprophyticus, Staphylococcus carnosus, Streptococcus agalactiae, Streptococcus agalactiae, Streptococcus agalactiae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pneumoniae, Streptococcus gordonii, Streptococcus equi, Streptococcus equi, Streptococcus uberis, Streptococcus thermophilus, Streptococcus thermophilus, Streptococcus thermophilus, Streptococcus pneumoniae, Streptococcus pneumoniae, Streptococcus thermophilus, Streptococcus equi, Streptococcus mutans* | Q6F9E6, B2UM17, A8FF15, Q65HI8, Q1WUJ3, C4ZBG7, Q5LAX0, Q64RB7, Q8A7B8, A7ZCH3, A0RQ49, A3DEE6, B8J466, Q72F91, A1VGV4, B9M769, A5GAM5, Q39WH4, Q74EU7, Q7VGF6, A4XY05, A4XXZ2, Q48HJ1, Q88LI7, Q8XZ10, Q2JZV0, Q2KCC6, Q92RY3, Q989A7, Q93E15, Q1MLB6, Q92T88, A5VAA8, Q49WI7, B9D045, Q3K2M6, Q8E168, Q8E6M3, B5XM84, Q1JAV4, Q5X1324, Q1JL04, A2RDM9, P0DF89, Q1JG29, Q1J5U5, P0DF88, Q48SM7, Q7CN13, Q99YX2, Q97RI9, A8AW32, C0M7V0, B4U1W4, B9DUU0, Q03LK0, P96050, Q5M0P7, Q04L84, Q8DQD3, Q5M583, C0MD36, Q8DVC1 | P13995 |
| 998 | ITPVPGGVGPMTVAMLM | *Haemophilus influenzae, Haemophilus influenzae, Haemophilus influenzae, Haemophilus influenzae* | Q4QMI7, A5UAS4, P44313, A5UHL4 | P11586 |
| 999 | ITSCTNTSNPSVM | *Corynebacterium diphtheriae* | Q6NH63 | P21399 |
| 1000 | ITVGILLSY | *Bacillus subtilis* | C0SPB2 | O95528 |
| 1001 | ITVSEEVALKQA | *Streptococcus pyogenes* | Q99YC0 | Q9H0R6 |
| 1002 | IVAGGDGTL | *Staphylococcus carnosus* | B9DMT6 | Q53H12 |
| 1003 | IVEDIIDTG | *Streptococcus pyogenes, Streptococcus pyogenes, Streptococcus pyogenes, Streptococcus pyogenes* | Q5XEL6, Q7CNQ9, P0DD40, P0DD41 | P00492 |
| 1004 | IVETEAYLG | *Listeria innocua, Listeria monocytogenes, Listeria monocytogenes, Listeria* | Q92D89, P58621, B8DEK7, C1L1K0, Q721N6, A0AH42, | P29372 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | monocytogenes, Listeria monocytogenes, Listeria welshimeri, Staphylococcus haemolyticus, Staphylococcus epidermidis, Staphylococcus epidermidis, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q4L8K2, Q5HLQ3, Q8CRC1, B9DLR4, P65416, Q6G6X6, A8Z534, Q5HDL2, P65415, P65414, A6QJI5, Q2FVS1, A5IVC5, Q2FEF3, A7X5V7, A6U471, Q2YYZ2, Q6GE90 | |
| 1005 | IVKYSPDCII | Bacillus methylotrophicus | A7Z7J8 | P07195 |
| 1006 | IVLADADLD | Lactobacillus casei | A5YBJ3 | P00352 |
| 1007 | IVLMAQIGCFVP | Clostridium acetobutylicum | Q97119 | P43246 |
| 1008 | IVLVDDSIVRG | Staphylococcus epidermidis, Staphylococcus epidermidis | Q5HQA0, Q8CT30 | Q06203 |
| 1009 | IVNAANSSL | Escherichia fergusonii | B7LT90 | Q9BQ69 |
| 1010 | IVNAANSSLLGGG GVDG | Streptomyces griseus | Q9KHE2 | Q9BQ69 |
| 1011 | IVSNASCTTNC | Aeromonas hydrophila, Aeromonas salmonicida | A0KGD2, A4SRF2 | O14556 |
| 1012 | IVSNASCTTNCLA PLAKVI | Citrobacter freundii, Escherichia hermannii, Escherichia fergusonii, Escherichia vulneris | P24748, P24750, P0C8Z1, P24751 | O14556 |
| 1013 | IVVATPGRL | Bacillus cereus | Q81DF9 | Q9GZR7 |
| 1014 | IVVTDGERILGLGD | Aeromonas hydrophila, Aeromonas salmonicida, Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis | A0KHR8, A4SKE9, A8AGN6, C5BCM3, A4WAJ3, B1IRX9, A8A036, P26616, B1XE70, C4ZWP8, B1LFD8, Q8FHH1, B7LQX1, B7N4P2, B7LZ73, B7MUR3, B7L7H9, A7ZLS1, Q1RBT9, Q0THU1, A1AB75, B7NHU3, B7MMW1, B7URL9, B5Z1T9, Q8XAS9, A6T9K7, B5XX25, B4ESY2 | P48163 |
| 1015 | IYAAGDICT | Bacillus halodurans, Bacillus cereus, Bacillus cereus, Bacillus cereus, Bacillus thuringiensis, Bacillus thuringiensis, Bacillus anthracis, Bacillus weihenstephanensis | Q9K7F3, Q816D9, Q632D6, Q72YF6, Q6HBX6, A0RKB9, Q81XS0, A9VMZ3 | Q8WU10 |
| 1016 | IYARGAQDMK | Campylobacter jejuni, Campylobacter lari, Campylobacter jejuni, Campylobacter jejuni, Campylobacter jejuni, Campylobacter jejuni, Campylobacter curvus, Campylobacter hominis | A8FMA1, B9KD35, Q5HU53, A1W038, Q0P9K4, A7H2V9, A7GX37, A7I005 | Q03154 |
| 1017 | IYRIDHYLGKE | Pseudomonas aeruginosa | O68282 | P11413 |
| 1018 | KADIGIAMG | Staphylococcus haemolyticus | Q4L970 | P50993 |
| 1019 | KAEKNAVSHR | Ralstonia solanacearum | Q8XXF4 | Q9BY32 |
| 1020 | KAFAAGADIKEMQ | Rhizobium meliloti | Q52995 | P30084 |
| 1021 | KAGRNRWLG | Sphingomonas wittichii | A5V5Z9 | Q5T653 |
| 1022 | KASGLAAGKGV | Fusobacterium nucleatum | Q8REV7 | P22102 |
| 1023 | KATSNICTAQALL | Neisseria gonorrhoeae | B4RN40 | P23378 |
| 1024 | KATSNICTAQALLA N | Neisseria gonorrhoeae, Neisseria meningitidis, Neisseria meningitidis, Neisseria meningitidis | Q5F761, A1KV85, A9M1P7, Q9JT86 | P23378 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1025 | KDDRTGTGT | Lactobacillus plantarum, Lactobacillus helveticus, Corynebacterium diphtheriae, Corynebacterium glutamicum, Corynebacterium glutamicum, Corynebacterium efficiens | Q88W05, A8YUW0, Q6NIF2, Q8NS38, A4QCI7, Q8FR47 | P04818 |
| 1026 | KDGEAVWFG | Lactobacillus delbrueckii, Lactobacillus helveticus, Lactobacillus delbrueckii | P94869, P94870, P94868 | Q13867 |
| 1027 | KDGPLDMRMD | Aeromonas hydrophila, Aeromonas salmonicida, Aggregatibacter aphrophilus, Desulfovibrio salexigens, Haemophilus influenzae, Haemophilus influenzae, Haemophilus influenzae, Haemophilus somnus, Haemophilus influenzae, Stenotrophomonas maltophilia, Stenotrophomonas maltophilia | A0KPY0, A4SI48, C6AKG2, C6BYH4, A5UCX6, Q4QLG6, P45057, Q0I1E1, A5UIQ3, B2FNN0, B4SJW8 | A6NJ78 |
| 1028 | KDVKWILGQDPYHGP | Listeria monocytogenes, Listeria monocytogenes, Listeria innocua | Q720K2, Q8Y7P6, Q92CI1 | P13051 |
| 1029 | KDVKWILGQDPYHGPNQAHG | Clostridium perfringens, Clostridium perfringens, Clostridium perfringens | Q0TUH0, Q0SWB8, Q8XNR7 | P13051 |
| 1030 | KDVKWILGQDPYHGPNQAHGL | Haemophilus parasuis | B8F6C3 | P13051 |
| 1031 | KDYYEILGVSR | Edwardsiella ictaluri | C5B7L8 | Q9NXW2 |
| 1032 | KDYYKILGV | Propionibacterium acnes | Q6A662 | Q99615 |
| 1033 | KEEIFGPVL | Pseudomonas aeruginosa | Q9I702 | P30038 |
| 1034 | KEEIFGPVM | Stenotrophomonas maltophilia, Stenotrophomonas maltophilia | B2FQ90, B4SHW0 | P05091 |
| 1035 | KEGLALINGTQ | Fusobacterium nucleatum | Q8RDU4 | P42357 |
| 1036 | KEIFLRELISN | Bacillus subtilis, Clostridium botulinum, Clostridium botulinum, Clostridium botulinum, Clostridium botulinum, Clostridium botulinum, Clostridium botulinum, Clostridium botulinum | P46208, C3KXP4, A5I3130, A7FV42, C1FPN9, B1IN79, A7GEU9, B1KUN4 | P14625 |
| 1037 | KEIFLRELISNASDA | Bacillus clausii, Bacillus methylotrophicus, Bacillus halodurans | Q5WJE6, A7ZAI5, Q9KE51 | P14625 |
| 1038 | KERKGDYLG | Clostridium kluyveri, Clostridium cellulolyticum | A5N3K4, B8I598 | P17812 |
| 1039 | KERRGDYLG | Methylobacterium sp., Desulfovibrio vulgaris, Desulfovibrio vulgaris, Desulfovibrio vulgaris, Desulfovibrio alaskensis, Methylobacterium radiotolerans, Methylobacterium nodulans, Methylobacterium populi, Methylobacterium extorquens, Rhizobium etli, Rhizobium meliloti, Rhizobium etli, Rhizobium leguminosarum, Rhizobium leguminosarum, Staphylococcus carnosus, Staphylococcus haemolyticus, Staphylococcus saprophyticus, Staphylococcus epidermidis, Staphylococcus epidermidis | B0U802, Q72BL2, A1VDL2, B8DJR8, Q310T4, B1M5Q9, B8IP92, B1Z9R0, B7KUU9, B3Q30M2, Q92QA0, Q2K871, Q1MGC4, B5ZPZ7, B9DME0, Q4L808, Q49Z73, Q8CNI2, Q5HM95 | Q9NRF8 |
| 1040 | KEVILSGGA | Staphylococcus aureus, Staphylococcus aureus | Q8NUM0, Q6G664 | Q8NE62 |
| 1041 | KEVTLLGQNVN | Pseudomonas stutzeri, Pseudomonas mendocina | A4VQY3, A4XYW1 | Q965Z6 |
| 1042 | KEVTLLGQNVNS | Clostridium beijerinckii, Geobacter uraniireducens, Geobacter sulfurreducens | A6LWI1, A5G670, Q74644 | Q965Z6 |
| 1043 | KFYQASTSE | Aggregatibacter actinomycetemcomitans | Q9JRN5 | Q60547 |
| 1044 | KFYTEDGNWDLVGNNTP | Staphylococcus warneri, Staphylococcus epidermidis, Staphylococcus epidermidis, Staphylococcus epidermidis, Staphylococcus haemolyticus | Q9KW19, Q2PUJ9, Q8CPD0, Q5HPK8, Q4L643 | P04040 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1045 | KGAMLTHGN | *Haemophilus influenzae* | P46450 | Q9UKU0 |
| 1046 | KGILLYGPPG | *Kocuria rhizophila* | B2GIP2 | P46459 |
| 1047 | KGLYKKARAGE | *Citrobacter koseri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae* | A8ANW4, A4WDV5, B7LWK5, Q1R7U1, Q8FEJ2, A1AEU4, B7MYQ5, B7NT94, B7UHG9, B7MKM4, B1LQ71, B7N6Y0, B616E0, P0A6J1, B1XCS6, A8A3M9, C4ZZQ4, B7LXG2, B5Z3B2, P0A6J2, B7LEG8, A7ZQJ4, Q0TEA8, B1IU59, A6TD42, B5XV31 | Q43252 |
| 1048 | KGLYKKARAGEI | *Aeromonas hydrophila, Aeromonas salmonicida* | A0KP33, A4SRG6 | O43252 |
| 1049 | KGRTPNPDI | *Finegoldia magna* | B0S3R4 | O75648 |
| 1050 | KGSLLWVLD | *Clostridium cellulolyticum, Clostridium tetani* | B812Q5, Q895H2 | P20585 |
| 1051 | KIDPYINID | *Helicobacter pylori, Helicobacter pylori, Helicobacter pylori* | Q9ZM99, O25116, Q1CUG1 | P17812 |
| 1052 | KIFITHLHGDH | *Bacillus methylotrophicus, Bacillus licheniformis, Lactobacillus plantarum, Lactobacillus fermentum, Bacillus cereus, Bacillus cereus, Bacillus cereus, Bacillus cereus, Bacillus thuringiensis, Bacillus thuringiensis, Bacillus cereus, Bacillus cereus, Bacillus anthracis, Bacillus anthracis, Bacillus anthracis, Lactobacillus brevis, Bacillus cereus, Bacillus cereus, Bacillus cereus, Bacillus weihenstephanensis, Lactobacillus reuteri, Lactobacillus reuteri, Bacillus cytotoxicus, Leuconostoc mesenteroides, Listeria monocytogenes, Pediococcus ntosaceus, Proteus mirabilis, Streptococcus sanguinis, Streptococcus mutans, Streptococcus uberis, Streptococcus equi, Streptococcus gordonii, Streptococcus equi, Streptococcus equi, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes* | A7Z6F0, Q65HN6, Q88VG6, B2GBD1, B9IXD7, Q731F6, B7HNQ7, Q635E2, Q6HE20, A0RID9, C1ER14, B7JLZ5, Q81M88, C3LJR8, C3P7S4, Q03QP5, B7HB12, B7IWQ5, Q818V3, A9VG79, B2G6S0, A5VJA0, A7GSG2, Q03W55, B8DBV5, Q03F36, B4EUI8, A3CNR9, Q8DT90, B9DUP5, C0MAM9, A8AWX4, C0MDJ9, B4U3M1, B5XL36, Q48TY8, Q8P1A6, A2REY2, Q1JH87, Q1J705, Q5XCH7, P0DF23, Q1JM42, P0DF22, Q1JC59, P60199 | Q9H777 |
| 1053 | KIGHGGTLD | *Streptococcus pneumoniae, Streptococcus pneumoniae, Streptococcus pneumoniae, Streptococcus gordonii, Streptococcus pyogenes, Streptococcus pyogenes, Streptococcus agalactiae, Streptococcus agalactiae, Streptococcus agalactiae, Streptococcus pyogenes, Streptococcus pyogenes, Streptococcus pyogenes, Streptococcus pyogenes, Streptococcus pyogenes,* | Q97QJ3, Q8CWR2, Q04KA7, A8AX28, P0DD49, P0DD48, Q3K189, P65856, P65857, A2RE90, Q1JLG7, Q1J6C1, P65858, Q5XBX7, P65859, Q1JBI5, Q1JGK3, Q48TB3, Q5LZV2, Q5M4G2 | Q8WWH5 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus pyogenes, Streptococcus pyogenes, Streptococcus pyogenes, Streptococcus thermophilus, Streptococcus thermophilus* | | |
| 1054 | KIIRKEIPA | *Haemophilus influenzae* | P44956 | P49773 |
| 1055 | KILILDEAT | *Lactobacillus brevis* | Q03PY5 | O15440 |
| 1056 | KILNLRVFED | *Bifidobacterium longum, Bifidobacterium longum, Bifidobacterium longum* | B3DQN7, B7G087, Q8G4Q2 | Q8TEA8 |
| 1057 | KIRLTGGEP | *Haemophilus influenzae, Haemophilus influenzae, Haemophilus influenzae, Haemophilus influenzae, Stenotrophomonas maltophilia, Stenotrophomonas maltophilia* | P45311, Q4QJR9, A5UFB4, A5UBK4, B2FUM0, B45L67 | Q9NZB8 |
| 1058 | KIRLTGGEPL | *Bacillus cytotoxicus, Bacillus licheniformis, Bacillus methylotrophicus, Bacillus subtilis, Campylobacter curvus, Campylobacter fetus, Pseudomonas syringae, Pseudomonas savastanoi, Pseudomonas syringae, Pseudomonas putida, Pseudomonas putida, Pseudomonas putida, Pseudomonas entomophila, Pseudomonas putida, Ralstonia solanacearum, Rhizobium etli, Rhizobium etli, Rhizobium leguminosarum* | A7GU01, Q65DY5, A7Z9P0, P39757, A7GWA5, A0RMJ2, Q4ZU05, Q48HV8, Q882V6, B1JCVV0, Q88E69, A5VZZ2, Q1I6J5, B0KST1, Q8Y0K4, B3PQ08, Q2K7L4, B5ZRM8 | Q9NZB8 |
| 1059 | KIRLTGGEPLIRP | *Pseudomonas fluorescens* | Q3KA58 | Q9NZB8 |
| 1060 | KKLDVLSND | *Acinetobacter baylyi* | Q6F982 | P09467 |
| 1061 | KKRVFSGIQPTG | *Helicobacter pylori, Helicobacter pylori* | P56396, Q9ZJX4 | Q9UGM6 |
| 1062 | KKVSLELGG | *Escherichia coli, Pseudomonas putida, Pseudomonas aeruginosa* | P25526, Q88RC0, Q9I6M5 | Q3SY69 |
| 1063 | KKVSLELGGKSP | *Staphylococcus saprophyticus, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q49Z69, Q5HMA0, Q8CNI5, Q4L803, Q8NVG4, Q6G7I8, Q2FWD6, Q7A4D8, Q99SD6, Q5HE78, Q2FF06, Q6GEV3, Q2YUN1 | Q3SY69 |
| 1064 | KKWCDDYFF | *Citrobacter koseri* | A8ADF0 | P36551 |
| 1065 | KLAAFMKKF | *Bacillus subtilis* | P80862 | Q9Y617 |
| 1066 | KLAKQYHPD | *Clostridium phytofermentans* | A9KKT9 | Q9NX36 |
| 1067 | KLAMKYHPD | *Rhizobium sp., Rhizobium meliloti* | C3MC05, Q92T07 | Q9UBS3 |
| 1068 | KLFVDTDAD | *Bacillus halodurans, Bacillus cytotoxicus, Bacillus cereus, Bacillus Cl thuringiensis, Bacillus cereus, Bacillus cereus, Bacillus thuringiensis, Bacillus cereus, Bacillus cereus, Bacillus cereus, Bacillus cereus, Bacillus anthracis, Bacillus anthracis, Bacillus anthracis, Bacillus cereus, Bacillus cereus* | Q9KDD8, A7GT59, E555, Q6HDE5, B7JP70, Q634G4, A0RIZ3, B7IYN4, Q730F4, B9IYE5, B7HQD8, Q81LK8, C3L5Y6, C3P969, B7HE15, Q817Z5 | Q9BZX2 |
| 1069 | KLHTGRSRNDQV | *Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas salmonicida, Aeromonas hydrophila, Citrobacter koseri, Clostridium thermocellum, Clostridium* | B0VDE4, B7H1L9, B71338, A3M1E0, B0VMC7, B2I1W9, Q6FFB2, A4SIM6, A0KFV4, A8AKW2, A3DBU0, Q8XMJ8, Q0TTA6, B8I1A0, A7GGQ8, A0Q1Z1, B1IK07, A9KQ51, C3L1U2, C1FU67, | P04424 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | perfringens, Clostridium perfringens, Clostridium cellulolyticum, Clostridium botulinum, Clostridium novyi, Clostridium botulinum, Clostridium phytofermentans, Clostridium botulinum, Clostridium botulinum, Clostridium botulinum, Clostridium botulinum, Desulfovibrio vulgaris, Desulfovibrio vulgaris, Desulfovibrio vulgaris, Desulfovibrio desulfuricans, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Haemophilus influenzae, Haemophilus somnus, Haemophilus influenzae, Haemophilus influenzae, Haemophilus influenzae, Haemophilus parasuis, Klebsiella pneumoniae, Klebsiella pneumoniae, Proteus mirabilis, Pseudomonas fluorescens, Pseudomonas stutzeri, Pseudomonas aeruginosa, Pseudomonas aeruginosa, Pseudomonas aeruginosa, Pseudomonas fluorescens, Pseudomonas aeruginosa, Pseudomonas mendocina, Pseudomonas syringae, Pseudomonas putida, Pseudomonas savastanoi, Pseudomonas syringae, Pseudomonas putida, Pseudomonas entomophila, Pseudomonas putida, Pseudomonas fluorescens | A5I5A3, A7FWU5, B1KXY0, B8DN65, A1VEQ1, Q72D36, B8IZ53, C5BC57, A4WG51, B5Z062, Q8X730, B6I5H6, B7M714, B7LA60, A7ZUH8, Q1R3V1, Q8FB96, Q0TAA0, A1AID8, B7MR51, B7MI96, B7LUN5, B7NFR0, P11447, B1IVB8, A8A768, C5A0Q9, B1XBC5, B7NU40, B7UNT6, Q4QM89, Q0I2U1, P44314, A5UDR3, A5UHW3, B8F531, A6TGE4, B5XZ16, B4F1G9, C3K426, A4VGX6, B7V5F3, Q02EA0, P50987, Q4K3X1, A6VE40, A4XNY5, Q88694, P59618, Q48QD3, Q500N3, B1J1V0, Q1I314, B0KH03, Q3K4S8 | |
| 1070 | KLSGGEKQRVAI | Rhizobium loti | Q98KI3 | O75027 |
| 1071 | KLTPNVTDI | Lactobacillus casei, Lactobacillus johnsonii | Q038Z3, Q74J29 | Q12882 |
| 1072 | KLTPNVTDIV | Lactobacillus helveticus, Lactobacillus acidophilus, Lactobacillus delbrueckii, Lactobacillus delbrueckii, Lactobacillus plantarum | A8YVZ9, Q5FJB5, Q047M3, Q1G864, P77887 | Q12882 |
| 1073 | KLYVRRVFITDD | Rhizobium loti | Q98JB6 | P14625 |
| 1074 | KMKETAEAYLG | Rhizobium loti | Q98DD1 | P11021 |
| 1075 | KMSKSLGNV | Bacillus halodurans | Q9K9V0 | P26640 |
| 1076 | KMSKSLGNVI | Lactobacillus johnsonii, Staphylococcus epidermidis, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q74JX6, Q846V6, Q8CSX1, Q5HPZ9, Q4L5P4, Q2YXH4, Q6GHP2, P41972, A8Z3N1, P67509, Q5HGN8, P67508, A6QG93, A5IS79, Q2FZ82, Q2FHP4, A6U113, A7X1D8 | P26640 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1077 | KMSKSLGNVVDP | Rhizobium meliloti | Q92PX0 | Q96GW9 |
| 1078 | KMVHNGIEY | Bacillus subtilis | P12013 | P52209 |
| 1079 | KNRYVGRTFIQP | Bacillus subtilis | P00497 | Q06203 |
| 1080 | KNTYGTGCFLL | Fusobacterium nucleatum, Clostridium perfringens, Clostridium perfringens, Clostridium perfringens, Clostridium acetobutylicum, Clostridium beijerinckii | Q8RHZ9, Q0TMA0, Q8XHD3, Q0SQ01, Q97JG4, A6M1Y8 | Q14409 |
| 1081 | KPDILLLDEP | Bacillus subtilis | P37494 | Q86UQ4 |
| 1082 | KPHVNVGTIGHVDHG | Acinetobacter baylyi, Acinetobacter baumannii, Acinetobacter baumannii, Akkermansia muciniphila, Desulfitobacterium hafniense, Desulfitobacterium hafniense, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus ducreyi, Haemophilus somnus, Haemophilus influenzae, Haemophilus influenzae, Helicobacter hepaticus, Klebsiella pneumoniae, Neisseria gonorrhoeae, Neisseria meningitidis, Neisseria meningitidis, Neisseria meningitidis, Neisseria gonorrhoeae, Pseudomonas aeruginosa, Pseudomonas aeruginosa, Pseudomonas aeruginosa, Pseudomonas mendocina, Pseudomonas stutzeri, Pseudomonas stutzeri, Pseudomonas fluorescens, Ralstonia solanacearum | Q6FF97, A3M1F6, B7H1K5, B2UQY9, Q250N4, B8G1W4, A4W5A0, P0A6N2, P0A6N3, Q1R5U4, P0CE48, B1IVA7, Q0TA85, A1AIF3, A8A779, A7ZUJ2, Q1R5Y2, A1AGM6, P0CE47, B1IPW0, Q0TCC0, A8A5E6, A7ZSL4, Q7TTF9, Q0I1U9, P43926, A5UHC1, Q7VJ74, A6TEX7, Q5F5Q8, P64027, A1KRF9, P64026, P48864, P09591, Q02T82, A6UZH4, A4XZ92, A4VHM8, A4VHL6, Q4K519, Q8XGZ0 | P49411 |
| 1083 | KPNIVLIMVD | Clostridium perfringens, Clostridium perfringens | Q8XNV1, Q0TUK6 | P54793 |
| 1084 | KPRYLMGVG | Lactobacillus plantarum, Desulfovibrio alaskensis, Enterococcus faecalis | Q88V05, Q30XF7, Q837E7 | Q9BXR0 |
| 1085 | KPVIAAVNGYAFGGG | Citrobacter koseri, Escherichia coli, Escherichia coli, Escherichia coli, Escherichia coli, Escherichia coli, Escherichia coli | A8ALR7, P31551, B1IRE0, Q8FLA6, Q0TLV3, B1LFW9, Q8XA35 | P30084 |
| 1086 | KQFTTVVAD | Escherichia coli, Escherichia coli, Escherichia coli | P0A868, P0A867, P0A869 | P37837 |
| 1087 | KQRVAIARA | Lactobacillus sakei, Lactobacillus brevis, Escherichia coli, Escherichia coli, Escherichia coli, Escherichia coli, Escherichia coli, Haemophilus ducreyi, Haemophilus influenzae, Haemophilus influenzae, Haemophilus somnus, Helicobacter hepaticus, Staphylococcus aureus, Staphylococcus aureus, Staphylococcus aureus, Streptococcus mutans | Q38WL5, Q03P57, P30750, Q1RFY9, P63355, P63356, Q0TLD2, Q7VM95, P44785, Q4QMH4, Q0I5E9, Q7VI92, Q2FJI0, Q2GOV2, Q5HIL5, Q93DA2 | O75027 |
| 1088 | KRIHEYKRQL | Escherichia coli | P0AC86 | P06737 |
| 1089 | KSGYGLDLE | Pseudomonas entomophila, Pseudomonas syringae, Pseudomonas savastanoi, Pseudomonas syringae | Q1I3R1, Q87UL9, Q48CD3, Q4ZLW0 | Q96NU7 |
| 1090 | KSGYGLDLETE | Ralstonia solanacearum | Q8XW31 | Q96NU7 |
| 1091 | KSLDFYTRVLG | Pseudomonas putida | P16635 | Q04760 |
| 1092 | KSNILLLGPTG | Clostridium acetobutylicum | Q97FT7 | O76031 |
| 1093 | KSNILLLGPTGSGKTLLAQT | Clostridium tetani | Q891J8 | O76031 |
| 1094 | KSNILLLGPTGSGKTLLAQTLA | Clostridium novyi, ptoclostridium difficile, Clostridium beijerinckii, Clostridium kluyveri, Clostridium kluyveri, Geobacter sp., Geobacter | A0Q2L0, Q180E8, A6LT28, B9E684, A5N2K7, C6E2S9, B5EI28, Q74C83, | O76031 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | bemidjiensis, Geobacter sulfurreducens, Geobacter metallireducens, Geobacter daltonii, Geobacter uraniireducens, Streptomyces avermitilis, Streptomyces griseus, Streptomyces coelicolor | Q39UH3, B9M0Y2, A5GFA1, Q820F8, B1VXA8, Q9F316 | |
| 1095 | KSNILLLGPTGSG KTLLAQTLAK | Clostridium botulinum, Clostridium botulinum, Clostridium botulinum, Clostridium botulinum, TABLE 1-continued Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q5HRG5 | |
| 1107 | KYHPDKNPD | Rhizobium etli, Rhizobium radiobacter, Rhizobium etli, Rhizobium leguminosarum | Q2KDW7, Q6RSN5, B3PXH2, Q1MN12 | Q8WW22 |
| 1108 | LAAGNTVVI | Staphylococcus epidermidis, Staphylococcus epidermidis | Q5HLA3, Q8CN24 | O75891 |
| 1109 | LAAQSIGEP | Helicobacter hepaticus, Uncultured termite | Q7VJ82, B1GZ76 | O95602 |
| 1110 | LACARIGAIHS | Escherichia coli | P77495 | Q9H6R3 |
| 1111 | LADDMGLGKT | Bacillus subtilis | P94593 | Q2NKX8 |
| 1112 | LADYLVVNVSSPNT | Corynebacterium striatum, Corynebacterium efficiens, Corynebacterium glutamicum, Corynebacterium glutamicum | Q9FB59, Q8FTC6, Q8NQC0, A4QEA4 | Q02127 |
| 1113 | LASRDWSR | Helicobacter pylori, Helicobacter pylori | Q9ZMP0, O06913 | P31040 |
| 1114 | LATKAREGKL | Bacillus subtilis | P21883 | P10515 |
| 1115 | LAYEPVWAIG | Rhizobium etli | Q2JZQ2 | P60174 |
| 1116 | LAYEPVWAIGTGKTA | Bacteroides thetaiotaomicron, Parabacteroides distasonis | Q8A0U2, A6LFF0 | P60174 |
| 1117 | LAYEPVWAIGTGKTAT | Bacteroides vulgatus, Porphyromonas gingivalis, Porphyromonas gingivalis | A6KXL2, Q7MWI7, B2RII9 | P60174 |
| 1118 | LAYSGGLDT | Clostridium phytofermentans, Eubacterium eligens | A9KHL4, C4Z4C1 | P00966 |
| 1119 | LAYSGGLDTS | Lactobacillus plantarum, Clostridium thermocellum, Clostridium perfringens, Clostridium perfringens, Clostridium botulinum, Clostridium botulinum, Micrococcus luteus, Streptococcus agalactiae, Streptococcus agalactiae, Streptococcus agalactiae, Streptococcus suis, Streptococcus suis, Streptococcus mutans, Streptococcus thermophilus, Streptococcus thermophilus, Streptococcus thermophilus, Streptococcus pneumoniae, Streptococcus pneumoniae, Streptococcus pneumoniae, Streptococcus sanguinis, Streptococcus gordonii | P59603, A3DBU1, Q0TTA5, Q8XMJ7, B2TQ23, B2UYI0, C5CAM5, Q8E7N1, Q8E272, Q3K3Q4, A4VXZ4, A4W488, Q8CVVZ0, Q03IP8, Q5M2K2, Q5LXZ8, Q04MW7, Q8DRI5, B1I814, A3CQQ4, A8AUN6 | P00966 |
| 1120 | LDEADRMLDMGF | Escherichia coli | P21507 | Q92841 |
| 1121 | LDEATSALD | Campylobacter jejuni, Haemophilus influenzae, Neisseria meningitidis, Neisseria meningitidis, Neisseria gonorrhoeae, Rhizobium radiobacter, Rhizobium loti, Rhizobium meliloti, Rhizobium etli, Rhizobium leguminosarum | Q0P9C4, Q57180, Q9JXR3, Q9JW59, Q5F4X8, P0A2V1, Q983H5, P18767, Q2K342, Q1MAB5 | Q9NUT2 |
| 1122 | LDEPTAGLDP | Bacillus subtilis, Lactobacillus salivarius, Lactobacillus sakei, ptoclostridium difficile, Clostridium perfringens, Clostridium perfringens, Clostridium tetani, Clostridium acetobutylicum, Enterococcus faecalis, Staphylococcus epidermidis, Staphylococcus epidermidis, Streptococcus mutans, Streptococcus pyogenes, Streptococcus pyogenes, Streptococcus pyogenes, Streptococcus pyogenes, Streptococcus pyogenes, Streptococcus pyogenes, | P70970, Q1WSB9, Q38UU0, Q18CI9, Q0TMS8, Q8XHV3, Q890R3, Q97EK9, Q839D4, Q8CRI7, Q5HM28, Q8DRS0, Q48QM3, Q1JEC9, Q1J450, A2RH10, Q1JJD0, Q7CMM8, Q1J983, Q5X9B6, Q99XI2, P0CZ27, P0CZ26, A3CRB8, Q8DMY0, Q04HV8, Q97N51, Q03I83, | Q8WWZ4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Streptococcus pyogenes, Streptococcus pyogenes, Streptococcus pyogenes, Streptococcus pyogenes, Streptococcus pyogenes, Streptococcus sanguinis, Streptococcus pneumoniae, Streptococcus pneumoniae, Streptococcus pneumoniae, Streptococcus thermophilus, Streptococcus thermophilus, Streptococcus thermophilus | Q5M244, Q5LXJ4 | |
| 1123 | LDEPTNHLD | Bacillus subtilis, Bacillus subtilis, Bacillus subtilis | O05519, O34512, Q06476 | O9UG63 |
| 1124 | LDGDNVRHGLN | Bacillus licheniformis, Bacillus pumilus, Clostridium kluyveri | Q65JT8, A8FD25, A5N960 | O95340 |
| 1125 | LDGDNVRHGLNR | Rhizobium tropici, Rhizobium sp., Rhizobium sp., Rhizobium meliloti | P52978, O07309, P72339, P13442 | O095340 |
| 1126 | LDGGMGTMIQ | Pseudomonas aeruginosa, Pseudomonas putida | Q9I2Q2, O33465 | Q99707 |
| 1127 | LDIGTGTGL | Bacteroides fragilis, Bacteroides fragilis, Bacteroides thetaiotaomicron | Q5LCS1, Q64TX7, Q8A9H7 | Q9NVM4 |
| 1128 | LDIPLLFET | Rhizobium etli, Rhizobium loti | Q2KE98, Q98DY2 | Q8WVC6 |
| 1129 | LDIPLLFETK | Rhizobium meliloti | Q92TE9 | Q8WVC6 |
| 1130 | LDKLRHTHV | Lactobacillus casei, Lactobacillus casei | Q038M5, B3WER5 | O60841 |
| 1131 | LDLCAAPGGK | Citrobacter koseri, Enterobacter sp., Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis | A8AQI3, A4WF97, Q1R644, A1AGI0, B7MCQ4, B7LRQ5, B7N0S9, Q8FD12, B7NLK8, B5YT08, Q8XEE5, B6I202, B7M0Z4, B7LHZ0, B7UK12, A7ZSH7, B1LGP5, P36929, B1IQ11, A8A593, C4ZUE3, B1X6E1, B7NDR0, B5XNC2, A6TEU2, B4F1L5 | Q9H649 |
| 1132 | LDQLKQFTTVVADTGDF | Ralstonia pickettii, Ralstonia solanacearum | B2U9W5, Q8Y014 | P37837 |
| 1133 | LDSARFRYF | Rhizobium loti | Q98EC4 | Q6ZMR3 |
| 1134 | LDSARFRYL | Staphylococcus epidermidis, Staphylococcus epidermidis | Q8CMZ0, Q5HL31 | P00338 |
| 1135 | LDSRGNPTVE | Lactobacillus salivarius, Lactobacillus fermentum | Q1WSY0, B2GAM0 | P13929 |
| 1136 | LDSRGNPTVEV | Lactobacillus sakei | Q38Y18 | P13929 |
| 1137 | LDTARFRFL | Bacillus caldotenax, Bacillus caldolyticus | P10655, Q59244 | Q9BYZ2 |
| 1138 | LDTKGPEIRT | Bacillus licheniformis, Bacillus subtilis, Escherichia coli, Escherichia coli, Staphylococcus saprophyticus | P51181, P80885, P0AD61, P0AD62, Q49YC7 | P30613 |
| 1139 | LDTKGPEIRTG | Clostridium acetobutylicum | O08309 | P30613 |
| 1140 | LDVAGGTGDIAFR | Rhizobium etli, Rhizobium etli, Rhizobium leguminosarum, Rhizobium leguminosarum, Rhizobium loti, Rhizobium meliloti, Rhizobium sp. | Q2KDB0, B3PZ92, Q1MME0, B5ZYK8, Q98GV1, Q925K7, C3MCY6 | Q5HYK3 |
| 1141 | LDVGCGSGIL | Clostridium phytofermentans | A9KKT8 | Q86X55 |
| 1142 | LDVGCGSGILS | Campylobacter lari, Campylobacter concisus, Campylobacter fetus, Helicobacter pylori, Helicobacter acinonychis, Helicobacter pylori, Helicobacter pylori, Helicobacter hepaticus | B9KDE1, A7ZES6, A0RQL1, O07678, Q17WN8, B2USL4, Q1CUC6, Q9ZM65, Q7VHY7 | Q86X55 |
| 1143 | LDVLINNAGI | Bacillus subtilis, Bacillus subtilis, Bacillus amyloliquefaciens | Q8KWT4, P39640, Q8KW59 | Q9HBH5 |
| 1144 | LDVLVNNAG | Streptomyces violaceoruber | P16543 | P16152 |
| 1145 | LDVLVNNAGI | Staphylococcus aureus, Staphylococcus aureus, Staphylococcus aureus, | Q5HGK2, P0A0I0, P0A0H9, Q6G9Y2, Q6GHK4, P99093 | P16152 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Staphylococcus aureus, Staphylococcus aureus | | |
| 1146 | LDYVDLYLLH | Pseudomonas putida | Q02198 | P17516 |
| 1147 | LEFVQFHPT | Ralstonia solanacearum | Q8XQG4 | P31040 |
| 1148 | LEGHLRSILG | Bacillus subtilis | O32076 | Q14254 |
| 1149 | LEINPLWT | Haemophilus parasuis, Rhizobium loti | B8F4Q2, Q98KT9 | P53396 |
| 1150 | LEINPLWTKD | Methylobacterium extorquens | P53594 | P53396 |
| 1151 | LELGGKSPLI | Pseudomonas putida, Pseudomonas sp. | P0A391, P0A390 | Q35Y69 |
| 1152 | LELIASENF | Desulfovibrio vulgaris, Desulfovibrio vulgaris, Desulfovibrio alaskensis, Desulfovibrio vulgaris, Geobacter bemidjiensis, Geobacter sp., Geobacter metallireducens, Geobacter uraniireducens, Geobacter daltonii, Geobacter sulfurreducens, Geobacter lovleyi | A1VEK5, Q72CT0, Q30YL7, B8DJF7, B5E8U0, C6E348, Q39V87, A5GF66, B9M0W5, Q74CR5, B3E1Z8 | P34896 |
| 1153 | LELLEGKILPGV | Geobacter lovleyi | B3E9Q7 | P07205 |
| 1154 | LELRVPFLD | Bacillus subtilis | P54420 | P08243 |
| 1155 | LEYRGYDSAG | Bacillus clausii, Lactobacillus plantarum, Campylobacter jejuni, Helicobacter pylori, Helicobacter pylori, Staphylococcus aureus, Staphylococcus aureus, Staphylococcus aureus, Staphylococcus aureus, Staphylococcus aureus, Staphylococcus aureus | Q5WLG7, Q88YE7, Q9PMT4, O26060, Q9ZJ94, P64228, P64227, Q8NVE6, Q6G7F8, Q5HE49, Q6GE53 | Q06210 |
| 1156 | LFDEPTTGLD | Bacillus subtilis | P46903 | Q9H222 |
| 1157 | LFGTIDSWL | Lactobacillus acidophilus | Q5FHZ6 | Q14409 |
| 1158 | LFTLAESLGG | Escherichia coli | P00935 | P32929 |
| 1159 | LFVGSEGTLG | Bacillus subtilis | P94535 | Q86WU2 |
| 1160 | LGAGKTTLL | Escherichia coli, Pseudomonas aeruginosa | P24203, Q9HZQ2 | Q5RIA9 |
| 1161 | LGAGKTTLLN | Pseudomonas chlororaphis | P31521 | Q5RIA9 |
| 1162 | LGAQWGDEGKGK | Haemophilus parasuis, Haemophilus influenzae, Haemophilus influenzae, Haemophilus influenzae, Haemophilus influenzae, Haemophilus ducreyi, Streptomyces avermitilis, Streptomyces coelicolor, Streptomyces griseus | B8F8E6, A5UIZ2, Q4QL68, P45283, A5UCM6, Q7VKR5, Q82ER6, Q9X8P6, B1VMC3 | Q8N142 |
| 1163 | LGDVYVNDAFGTAHR | Lactobacillus plantarum | Q88YH5 | P07205 |
| 1164 | LGFPCNQFG | Staphylococcus epidermidis, Staphylococcus aureus, Staphylococcus aureus, Staphylococcus aureus, Staphylococcus aureus, Staphylococcus aureus, Staphylococcus aureus | Q8C5R9, Q6GHD0, P64291, Q6G9Q8, P64290, P99097, Q5HGC7 | P18283 |
| 1165 | LGGAKVADK | Propionibacterium acnes | Q6A9J3 | P07205 |
| 1166 | LGGRVKTLHP | Bacteroides thetaiotaomicron | Q8A155 | P31939 |
| 1167 | LGGTCVNVGCVPKK | Pseudomonas aeruginosa | P23189 | P00390 |
| 1168 | LGGTCVNVGCVPKKVM | Haemophilus influenzae | P43783 | P00390 |
| 1169 | LGGTCVNVGCVPKKVMW | Escherichia coli | P06715 | P00390 |
| 1170 | LGHVQRGGTPSAFDR | Streptomyces coelicolor | O08333 | Q01813 |
| 1171 | LGLPTGSTPL | Fusobacterium nucleatum, Edwardsiella ictaluri | Q8REG1, C5BGA6 | P46926 |
| 1172 | LGMGADGHT | Aggregatibacter actinomycetemcomitans | P70715 | O95479 |
| 1173 | LGNNKITDI | Listeria monocytogenes | P25147 | Q9BXN1 |
| 1174 | LGPNGAGKST | Streptomyces ucetius | P32010 | Q8WWZ7 |
| 1175 | LGPNGAGKTT | Bacillus subtilis, Bacillus subtilis | O07016, P42246 | Q86UK0 |
| 1176 | LGPNGAGKTTTI | Bacillus subtilis | P54592 | Q86UK0 |
| 1177 | LGPPGAGKGTQA | Geobacter sulfurreducens, Rhizobium meliloti, Uncultured termite | Q749A8, Q93FE6, B1GZA3 | P54819 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1178 | LGPPGSGKGT | *Stenotrophomonas maltophilia, Stenotrophomonas maltophilia* | B4SI37, B2FT48 | P27144 |
| 1179 | LGPTGSGKT | *Eubacterium eligens, Clostridium cellulolyticum, Corynebacterium aurimucosum, Corynebacterium diphtheriae, Corynebacterium glutamicum, Corynebacterium glutamicum, Corynebacterium kropnstedtii* | C4Z1T5, B8I8F6, C3PI25, Q6NFU7, A4QGA7, Q8NN26, C4LJV6 | O76031 |
| 1180 | LGPTGSGKTLLA | *Desulfitobacterium hafniense, Desulfitobacterium hafniense* | Q24SJ9, B8FV10 | O76031 |
| 1181 | LGPTGSGKTLLAQTLA | *Clostridium thermocellum, Geobacter lovleyi* | A3DJ11, B3E1Z3 | O76031 |
| 1182 | LGRELGLPE | *Rhizobium sp., Rhizobium meliloti* | C3MCS5, Q92SQ3 | P49915 |
| 1183 | LGRKSGKGFY | *Clostridium acetobutylicum* | P52041 | P40939 |
| 1184 | LGSSQRFGVP | *Pseudomonas fluorescens* | Q4K416 | P23378 |
| 1185 | LGSVGEPIN | *Methylobacterium radiotolerans, Methylobacterium extorquens, Methylobacterium populi, Methylobacterium extorquens, Pseudomonas putida, Pseudomonas aeruginosa, Rhizobium loti* | B1M0M1, A9W5V0, B1ZB59, B7KPN8, Q88DW6, Q91558, Q98ET8 | Q9NUB1 |
| 1186 | LGTHDFSAF | *Clostridium thermocellum* | A3DJK8 | Q8N0Z8 |
| 1187 | LGVDKNASE | *Lactobacillus johnsonii, Lactobacillus gasseri, Fusobacterium nucleatum* | Q74IT7, Q044A8, Q70WY6 | Q99615 |
| 1188 | LGVPFNIASY | *Leuconostoc mesenteroides* | Q03YZ8 | P04818 |
| 1189 | LGVPFNIASYALL | *Parabacteroides distasonis, Bacteroides fragilis, Bacteroides fragilis, Bacteroides vulgatus, Bacteroides thetaiotaomicron* | A6LIC2, Q5L9L6, Q64PV5, A6L1Q8, Q8A639 | P04818 |
| 1190 | LGVPFNIASYALLT | *Lactobacillus casei, Lactobacillus casei, Staphylococcus epidermidis, Staphylococcus aureus, Staphylococcus epidermidis, Staphylococcus epidermidis* | Q039F7, P00469, P0C0M5, P0A0M5, Q5HMP6, P0C0M4 | P04818 |
| 1191 | LGVSRDASD | *Lactobacillus delbrueckii, Lactobacillus delbrueckii* | Q1G9R3, Q049W7 | Q9H819 |
| 1192 | LHDGPPYANG | *Lactobacillus brevis, Lactobacillus salivarius, Lactobacillus reuteri, Lactobacillus fermentum, Campylobacter hominis, Campylobacter lari, Campylobacter jejuni, Campylobacter jejuni, Desulfovibrio salexigens, Desulfovibrio alaskensis, Geobacter sulfurreducens, Haemophilus influenzae, Haemophilus influenzae, Haemophilus influenzae, HaemophiluS influenzae, Haemophilus ducreyi, Helicobacter pylori, Helicobacter pylori, Helicobacter pylori, Helicobacter pylori, Helicobacter pylori, Helicobacter pylori, Helicobacter acinonychis, Listeria welshimeri, Listeria innocua, Listeria monocytogenes, Listeria monocytogenes, Listeria monocytogenes, Listeria monocytogenes, Pediococcus ntosaceus, Pseudomonas putida, Pseudomonas putida, Pseudomonas putida, Pseudomonas putida, Pseudomonas aeruginosa, Pseudomonas syringae, Pseudomonas aeruginosa, Pseudomonas savastanoi, Pseudomonas aeruginosa, Pseudomonas aeruginosa, Pseudomonas entomophila, Pseudomonas fluorescens, Pseudomonas syringae,* | Q030I3, Q1WTA9, B2G6L2, B2GB86, A7I157, B9KD44, P41257, Q5HU41, C6BV89, Q30ZF7, Q747X9, Q4QLU5, A5UIA3, P43824, A5UDA6, Q7VP34, B6JNR5, P56456, Q1CRK7, Q9ZJJ1, B2UVG2, B5Z943, Q17ZG3, A0AKC5, Q929Z6, Q8Y5N8, Q71Y01, C1KWW3, B8DBR2, Q03EY9, A5VY52, Q88Q92, B1JF83, B0KM84, B7V0A3, Q4ZYJ4, Q9HVM4, Q48NK6, Q02GB7, A6VBU7, Q1I4S5, C3KDX4, Q889E4, P18330, A4VI60, Q4K5U4, Q3K6L5, A4XQV5, Q983N4, Q8NX29, Q6GA19, P0DG43, P0DG42, Q48SL8, Q5XB14, Q8P068, Q99YW3, Q8DNW4, Q04JB0, C1CSS4, B5E709, B1I721, Q8DVD3, C1CFN0, Q5M4X2, Q5M0Q5, Q03L88, P0CB61, B2IRR4, C1CLZ8, | Q9N5E4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Pseudomonas fluorescens, Pseudomonas stutzeri, Pseudomonas fluorescens, Pseudomonas fluorescens, Pseudomonas mendocina, Rhizobium loti, Staphylococcus aureus, Staphylococcus aureus, Streptococcus pyogenes, Streptococcus pyogenes, Streptococcus pyogenes, Streptococcus pyogenes, Streptococcus pyogenes, Streptococcus pyogenes, Streptococcus pneumoniae, Streptococcus pneumoniae, Streptococcus pneumoniae, Streptococcus pneumoniae, Streptococcus pneumoniae, Streptococcus mutans, Streptococcus pneumoniae, Streptococcus thermophilus, Streptococcus thermophilus, Streptococcus thermophilus, Streptococcus pneumoniae, Streptococcus pneumoniae, Streptococcus pneumoniae, Streptococcus pneumoniae, Streptococcus pneumoniae, Streptococcus agalactiae, Streptococcus agalactiae, Streptococcus agalactiae, Streptococcus sanguinis, Streptococcus gordonii* | C1C8P8, B8ZM55, Q8E177, Q3K2N4, Q8E6N1, A3CLP4, A8AW24 | |
| 1193 | LHDGPPYANGD | *Bacillus subtilis, Bacillus clausii, Ralstonia pickettii* | Q45477, Q5WFI3, B2UAQ4 | Q9NSE4 |
| 1194 | LHLGNYLGAI | *Rhizobium loti, Rhizobium meliloti* | Q98C31, Q92SI9 | Q9UGM6 |
| 1195 | LHRAFSVFLF | *Streptomyces coelicolor, Streptomyces griseus, Streptomyces avermitilis* | Q9X7Q6, B1VTW2, Q82MJ7 | Q13907 |
| 1196 | LHTGRSRNDQV | *Clostridium beijerinckii, Desulfovibrio alaskensis, Eubacterium eligens, Geobacter lovleyi, Geobacter daltonii, Geobacter uraniireducens, Geobacter sulfurreducens, Geobacter metallireducens, Geobacter sp., Geobacter bemidjiensis, Neisseria meningitidis, Neisseria meningitidis, Neisseria meningitidis, Neisseria gonorrhoeae, Ralstonia pickettii, Ralstonia solanacearum, Staphylococcus saprophyticus* | A6M1Z5, Q30Y139, C4Z0V2, B3E9X6, B9M377, A5GDA7, Q74GT9, Q39Z69, C6E6Y9, B5ED16, Q9JVG7, Q9K0G8, A9M2R4, A1KSP4, Q5FA15, B2UA10, Q8XWV7, Q49W99 | P04424 |
| 1197 | LIANRGEIA | *Bacillus subtilis* | P49787 | Q96RQ3 |
| 1198 | LIASENFAS | *Rhizobium loti* | Q98A81 | P34896 |
| 1199 | LIGADPREI | *Aeromonas hydrophila, Proteus mirabilis* | A0KJ32, B4EZU8 | Q9Y697 |
| 1200 | LIGQFGVGFYSAF | *Methylobacterium populi, Methylobacterium extorquens, Methylobacterium extorquens* | B1Z9Y8, A9W1H7, B7KPG0 | P14625 |
| 1201 | LILDEATSALD | *Acinetobacter baylyi, Bacillus subtilis, Escherichia coli, Escherichia coli, Escherichia coli, Escherichia coli, Escherichia coli, Ralstonia solanacearum* | Q6F9X0, P71082, Q1RDU4, Q8FJB1, Q0TJD9, P60752, P60753, Q8XXB6 | Q9NUT2 |
| 1202 | LILDEPTSG | *Escherichia coli* | P37624 | Q9H221 |
| 1203 | LISPFVGRILDW | *Haemophilus parasuis* | B8F5Q3 | P37837 |
| 1204 | LITGASSGIGL | *Acinetobacter baylyi* | Q6F7B8 | P56937 |
| 1205 | LIYTSGTTG | *Bacillus subtilis* | P39846 | Q5FVE4 |
| 1206 | LKGHRSVGG | *Bacillus cereus, Bacillus cereus, Bacillus cereus, Bacillus thuringiensis, Bacillus anthracis, Bacillus circulans, Listeria monocytogenes, Listeria monocytogenes, Listeria innocua,* | Q81BC0, Q638W1, Q734W9, Q6HGI0, C3P210, Q59196, Q8Y3L0, Q71VT6, Q926T3, Q885T5, | Q9Y617 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Pseudomonas syringae, Pseudomonas aeruginosa, Pseudomonas fluorescens, Pseudomonas aeruginosa, Pseudomonas aeruginosa, Pseudomonas aeruginosa, Pseudomonas mendocina, Pseudomonas putida, Pseudomonas entomophila, Pseudomonas syringae | A6V2Q8, C3K6J5, Q02PX3, B7V9J9, Q9HZ66, A4XTE7, Q88M07, Q1IDA2, Q4ZQ94 | |
| 1207 | LKGKQGRFR | Methylobacterium sp., Fusobacterium nucleatum, Bifidobacterium adolescentis, Bifidobacterium longum, Bifidobacterium longum, Bacteroides thetaiotaomicron, Bacteroides fragilis, Bacteroides fragilis, Bacteroides vulgatus, Parabacteroides distasonis, Bifidobacterium animalis, Clostridium perfringens, Clostridium perfringens, Clostridium perfringens, Corynebacterium glutamicum, Corynebacterium glutamicum, Corynebacterium efficiens, Corynebacterium urealyticum, Corynebacterium diphtheriae, Corynebacterium aurimucosum, Corynebacterium kropnstedtii, Corynebacterium jeikeium, Kocuria rhizophila, Methylobacterium populi, Methylobacterium extorquens, Methylobacterium extorquens, Methylobacterium radiotolerans, Methylobacterium nodulans, Porphyromonas cangingivalis, Propionibacterium acnes, Rhizobium meliloti, Rhizobium leguminosarum, Rhizobium etli, Rhizobium etli, Rhizobium loti, Sphingomonas wittichii, Streptococcus pyogenes, Streptomyces griseus, Streptomyces avermitilis, Streptomyces coelicolor | B0UHX5, Q8RHI7, A1A316, Q8G515, B3DTE1, Q8A470, Q64NJ8, Q5L898, A6KYK2, A6LE80, B8DWJ5, Q0SQD7, P0C2E8, Q0TMN9, A4QBG3, Q8NT25, Q8FS96, B1VES2, Q6NJF6, C3PKN2, C4LL70, Q4JT33, B2GIK0, B1ZGS1, A9W8N9, B7KN46, B1LY42, B8IS79, O33431, Q6A6K7, Q92QH6, Q1MIE8, B3PW60, Q2K9M3, Q98N65, A5VBZ7, P0C0D9, B1W441, Q82DQ4, Q8CJT1 | O14802 |
| 1208 | LKGRDLLTL | Bacillus halodurans | Q9K8V8 | P00480 |
| 1209 | LKLIADVGLVG | Arcobacter butzleri | A8EV83 | A4D1E9 |
| 1210 | LKLIADVGLVGFPN | Campylobacter fetus, Campylobacter hominis, Campylobacter jejuni, Campylobacter curvus, Campylobacter jejuni, Campylobacter jejuni, Campylobacter jejuni | A0RR37, A7I166, Q0PC41, A7H029, A8FJQ1, Q5HX70, A1VXH9 | A4D1E9 |
| 1211 | LKNDTFLRA | Neisseria meningitidis, Neisseria meningitidis, Neisseria meningitidis, Neisseria gonorrhoeae, Neisseria gonorrhoeae | Q9K041, A1KT40, Q9JV52, A9M3L2, B4RK59, Q5F9N1 | P06132 |
| 1212 | LLAAGQSST | Pseudomonas aeruginosa, Ralstonia solanacearum | Q9RPF3, Q8XSF6 | P49279 |
| 1213 | LLDEPTAGLDP | Listeria monocytogenes, Listeria monocytogenes | Q8Y7R4, Q720M2 | O94911 |
| 1214 | LLDGFPRTL | Lactobacillus sakei, Enterococcus faecalis | Q38UT2, Q839E3 | Q9UIJ7 |
| 1215 | LLDMKIFVDTD | Leuconostoc citreum | B1MXP1 | Q9NWZ5 |
| 1216 | LLDVAGGTGDIAFR | Methylobacterium nodulans | B8IJ00 | Q5HYK3 |
| 1217 | LLGGGGVDG | Listeria monocytogenes, Listeria monocytogenes, Listeria innocua | Q8Y3S3, Q71W03, Q926Y8 | Q9BQ69 |
| 1218 | LLGHNGAGKST | Bacillus cereus | Q737I0 | Q4W5N1 |
| 1219 | LLGPNGAGK | Bacillus subtilis, Streptomyces coelicolor, Streptomyces avermitilis | P94374, Q9RKC6, Q82HA2 | Q8WWZ7 |
| 1220 | LLGPNGAGKST | Escherichia coli | P36879 | Q8WWZ7 |
| 1221 | LLGPNGAGKTTT | Haemophilus influenzae | P45073 | Q86UK0 |
| 1222 | LLGPNGAGKTTTI | Bacillus subtilis | O31427 | Q86UK0 |
| 1223 | LLGPPGAGKGTQ | Methylobacterium extorquens, Methylobacterium radiotolerans, Methylobacterium populi, Methylobacterium extorquens | A9W4R9, B1LWQ5, B1Z772, B7L0S9 | P54819 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
| --- | --- | --- | --- | --- |
| 1224 | LLGPPGAGKGTQA | *Acinetobacter baylyi, Acinetobacter baumannii, Acinetobacter baumannii, Acinetobacter baumannii, Acinetobacter baumannii, Acinetobacter baumannii, Clostridium acetobutylicum, ptoclostridium difficile, Clostridium botulinum, Clostridium kluyveri, Clostridium kluyveri, Clostridium botulinum, Clostridium botulinum, Clostridium botulinum, Clostridium botulinum, Clostridium botulinum, Clostridium botulinum, Clostridium botulinum, Clostridium novyi, Clostridium tetani, Finegoldia magna, Geobacter daltonii, Geobacter uraniireducens, Rhizobium etli, Rhizobium etli, Rhizobium loti, Sphingomonas wittichii* | Q6FD71, B0VSA9, A3M3G1, B0V9Q9, B2HVT0, B7GXT4, B7I8U4, Q97EJ9, Q18CH9, B1KSK4, A5N4R8, B9DYD0, C3KVN0, B1IGD3, A5I7I5, C1FMT0, A7FZ52, A7GJ53, A0PXW7, Q890Q5, B0RZT0, B9M6F7, A5GAW3, Q2K9J5, B3PWU2, Q98N36, A5V5Y1 | P54819 |
| 1225 | LLHGDLWSGN | *Enterobacter aerogenes, Escherichia coli, Escherichia coli, Klebsiella pneumoniae* | P46381, P77739, P58065, P46382 | Q9H479 |
| 1226 | LLHGFPEFWY | *Bacillus subtilis* | O31581 | Q8IUS5 |
| 1227 | LLLDEPTNHLD | *Bacillus subtilis, Escherichia coli, Haemophilus influenzae, Rhizobium radiobacter, Staphylococcus epidermidis* | P39115, P43672, Q57242, P12622, P23212 | Q9UG63 |
| 1228 | LLLDEPTNHLDL | *Bacillus subtilis* | O31716 | Q9UG63 |
| 1229 | LLLDEPTNHLDLA | *Haemophilus influenzae* | P44808 | Q9UG63 |
| 1230 | LLNYQTMVCD | *Rhizobium meliloti, Rhizobium leguminosarum, Rhizobium etli, Rhizobium etli* | Q92O11, B5ZQP8, Q2K813, B3PP20 | P23378 |
| 1231 | LLYGPPGCGKTLIAKA | *Streptomyces griseus* | B1W303 | Q8NBU5 |
| 1232 | LMAKDLGLAQ | *Pseudomonas aeruginosa* | Q9I5I6 | P31937 |
| 1233 | LMAQIGCFVP | *Parabacteroides distasonis* | A6LG92 | P43246 |
| 1234 | LMKDAIKPNL | *Desulfitobacterium hafniense, Clostridium perfringens, Clostridium novyi, Clostridium perfringens, Clostridium perfringens, Clostridium beijerinckii, Clostridium botulinum, Clostridium botulinum, Clostridium botulinum, Clostridium botulinum, Clostridium botulinum, Clostridium botulinum, Clostridium botulinum* | Q251P8, Q0TMI3, A0PXN0, Q0SQ82, Q8XHL4, A6LPL1, A7GJB8, B1IGY1, A5I7P9, A7FZB0, C3KVU4, C1FND0, B2TI29, B2UXU5, B1KTC6 | P11586 |
| 1235 | LMRLDKPIG | *Pseudomonas mendocina* | A4Y0P0 | Q96H96 |
| 1236 | LMRLDKPIGT | *Haemophilus somnus, Pseudomonas stutzeri* | Q0I0W3, A4VGN3 | Q96H96 |
| 1237 | LNERHYGAL | *Bacillus cereus* | Q732Z5 | P07738 |
| 1238 | LNHASIIDG | *Bacillus licheniformis, Bacillus subtilis, Desulfovibrio desulfuricans, Geobacter bemidjiensis, Geobacter lovleyi* | Q65ML1, Q8KZM9, B8J3V0, B5EEV8, B3EAE0 | O75600 |
| 1239 | LNLIDTPGHVDF | *Fusobacterium nucleatum* | Q8RFD1 | Q8N442 |
| 1240 | LNLRVFEDE | *Clostridium perfringens, Clostridium perfringens, Clostridium perfringens* | Q0SRP4, Q8XJ24, Q0TP24 | Q8TEA8 |
| 1241 | LNPARDLGPR | *Streptococcus pneumoniae, Streptococcus pneumoniae* | P0A3Q8, P0A3Q7 | Q96P58 |
| 1242 | LNRKVLADLA | *Desulfovibrio vulgaris, Desulfovibrio salexigens* | B8DPM9, C6BRG8 | Q9BYC9 |
| 1243 | LNRRKGPAV | *Rhizobium meliloti, Rhizobium loti* | Q92KW2, Q98DZ1 | Q9Y2Z2 |
| 1244 | LPAGTYCDV | *Streptomyces thermoviolaceus, Streptomyces hygroscopicus* | P27350, P08486 | P04746 |
| 1245 | LPDLGPIGANGLAN | *Streptomyces coelicolor* | Q952B5 | O93099 |
| 1246 | LPGTLPVLN | *Clostridium acetobutylicum* | Q97EX9 | O75879 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1247 | LPGVGQNLQDHLE | Proteus mirabilis, Pseudomonas savastanoi, Pseudomonas syringae, Pseudomonas syringae, Pseudomonas mendocina | B4EX94, Q48CM7, Q4ZM63, Q88AE7, A4XPI5 | Q8NE62 |
| 1248 | LPHIGSATH | Citrobacter koseri, Enterobacter sp., Enterobacter agglomerans, Escherichia fergusonii, Klebsiella pneumoniae, Klebsiella pneumoniae | A8ARD9, A4W577, P58000, B7LTG7, B5XMZ4, A6TFG7 | Q9UBQ7 |
| 1249 | LPNSRIMIHQP | Campylobacter jejuni, Campylobacter jejuni, Campylobacter jejuni, Campylobacter jejuni, Neisseria gonorrhoeae, Neisseria meningitidis, Neisseria meningitidis, Neisseria meningitidis, Neisseria meningitidis | Q5HWX6, P54413, A7H1R0, A8FJZ3, A1VXS0, Q5F914, Q9JU33, Q9JZ38, A1KUD9, A9LZN9 | Q16740 |
| 1250 | LPVFLLGHSMGG | Bacillus subtilis | O34705 | Q99685 |
| 1251 | LPVMVWIHGG | Bacillus subtilis | P37967 | Q9UKY3 |
| 1252 | LQRIYGISFP | Finegoldia magna | B0S169 | A2RTX5 |
| 1253 | LQTREQHIRR | Stenotrophomonas maltophilia, Stenotrophomonas maltophilia | B45567, B2FQE7 | P23378 |
| 1254 | LQYRYLDLR | Leuconostoc mesenteroides | Q03WL7 | Q6PI48 |
| 1255 | LRGRGGAGFPTG | Rhizobium meliloti | P56913 | P49821 |
| 1256 | LRLQYRYLDLR | Lactobacillus salivarius | Q1WTU9 | Q6PI48 |
| 1257 | LRPETAQGIF | Bacillus cereus, Bacillus cereus, Bacillus anthracis, Bacillus thuringiensis, Clostridium tetani, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus haemolyticus, Staphylococcus saprophyticus | Q632E8, Q72YG8, Q81XT3, Q6HBZ1, Q899G6, B9DNL1, Q2YT14, P67035, P67034, A8Z4A4, Q6G902, Q6GGD5, P99129, A6QHA8, Q5HFJ5, A7X2W2, Q2FY08, A5IT93, Q2FGF8, A6U237, Q5HNY2, Q8CSD5, Q4L6R5, Q49Y08 | P41250 |
| 1258 | LRPHVVWFGE | Escherichia coli, Escherichia coli, Escherichia coli | Q8FIM4, Q8X8E0, P75960 | Q9NXA8 |
| 1259 | LRVFEDESG | Leuconostoc citreum | B1MZI4 | Q8TEA8 |
| 1260 | LRVVDASIMP | Acinetobacter baumannii, Acinetobacter baumannii, Acinetobacter baumannii, Acinetobacter baumannii, Acinetobacter baumannii, Acinetobacter baylyi, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Pseudomonas fluorescens, Pseudomonas putida, Pseudomonas fluorescens, Pseudomonas fluorescens, Pseudomonas entomophila, Pseudomonas putida, Pseudomonas putida, Pseudomonas aeruginosa, Pseudomonas aeruginosa, Pseudomonas | B7I895, B7GYG5, B0V945, B0VST3, B2HV79, Q6FDF9, B6I074, A7ZWV4, B7M2V5, B7L439, A7ZI50, P17444, B1J0W6, B1XE52, Q1RFM3, B7MCD0, B5Z1R0, Q8X6C6, B7N8L3, B7UJG4, Q0TKW1, Q8FKI9, B1LIJ7, A6T613, C3K3D3, A5WA97, Q3K5H3, Q4K4K7, Q1IG70, Q88CVV6, B0KN19, A6VEI3, Q9HTJ2, B7V5R3, Q02DZ0 | Q8NE62 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | aeruginosa, Pseudomonas aeruginosa | | |
| 1261 | LRYDLTVPFARY | Parabacteroides distasonis, Bacteroides fragilis, Bacteroides fragilis, Bacteroides thetaiotaomicron, Bacteroides vulgatus, Porphyromonas gingivalis | A6LIF7, Q5LAE0, Q64OS2, Q8A6N7, A6KXA6, Q7MTB3 | P12081 |
| 1262 | LSCQLYQRS | Acinetobacter baumannii, Acinetobacter baumannii, Acinetobacter baylyi, Aeromonas hydrophila, Aeromonas salmonicida, Bacillus subtilis, Bacillus methylotrophicus, Bacillus amyloliquefaciens, Bacillus subtilis, Bacillus pumilus, Bacillus halodurans, Bacillus clausii, Lactobacillus salivarius, Lactobacillus reuteri, Lactobacillus brevis, Corynebacterium jeikeium, Klebsiella pneumoniae, Listeria monocytogenes, Listeria monocytogenes, Listeria innocua, Listeria monocytogenes, Listeria monocytogenes, Listeria welshimeri, Ralstonia solanacearum, Rhizobium meliloti, Rhizobium loti, Rhizobium leguminosarum, Rhizobium etli, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus | B7H0P4, B7I4U0, Q6FER7, A0KG32, A4SIW7, P11044, A7Z5T3, P54081, E0U0H8, A8FEB9, Q9K7B5, Q5WDS1, Q1WU17, A5VJK9, Q03S95, Q4JX59, A6TDG3, C1KWH4, Q8Y626, Q92AD4, B8DDM8, Q71YE1, A0AJY0, Q8Y0U6, Q92NQ5, Q98KH9, Q1ME82, Q2K6G8, Q49XN8, P67048, Q6G9D4, P67046, A5ISV8, A7X2B3, P67047, A6U1P7, Q6GGY0, A8Z406, Q2YY40, Q5HFZ6, Q2FYK5, A6QGX8, Q2FH11, Q4L6D7 | P04818 |
| 1263 | LSCQLYQRSGD | Lactobacillus sakei, Propionibacterium acnes | Q38WX8, Q6A761 | P04818 |
| 1264 | LSDELNHASIIDG | Bacillus cereus, Bacillus anthracis, Staphylococcus aureus, Staphylococcus aureus, Staphylococcus aureus, Staphylococcus aureus, Staphylococcus aureus, Staphylococcus aureus, Staphylococcus aureus | Q81I05, Q81V80, Q5HIC5, P60121, Q8NXY3, Q6GBT7, P60120, Q6GJB8 | Q75600 |
| 1265 | LSGCGVYDG | Escherichia coli | P0ABU5 | P30042 |
| 1266 | LSGGEKQRI | Escherichia coli | P77279 | P33897 |
| 1267 | LSGGQKQRI | Bacillus subtilis, Bacillus subtilis, Escherichia coli, Escherichia coli, Escherichia coli, Rhizobium sp., Rhizobium meliloti | O07550, P54718, P77265, P22520, Q9EXN5, P55469, Q92LX3 | Q9NRK6 |
| 1268 | LSGGQKQRIAIARA | Bacillus subtilis | O31707 | Q9NRK6 |
| 1269 | LSGGQKQRL | Bacillus subtilis, Pediococcus acidilactici, Staphylococcus aureus, Staphylococcus aureus, Staphylococcus aureus, Staphylococcus aureus, Staphylococcus aureus, Staphylococcus aureus, Staphylococcus aureus, Staphylococcus aureus | P45861, P36497, Q2G2M9, Q6GFJ1, Q5HEQ8, Q99T13, Q2FFM9, Q7A0J1, Q6G868, Q7A4T3, Q2YU20 | Q9NUT2 |
| 1270 | LSGGQKQRV | Bacillus clausii, Bacillus licheniformis, Clostridium tetani, Clostridium perfringens, Corynebacterium | Q5WCI1, Q65P77, Q895C4, Q8XK20, Q6NJ07, Q8Y454, | P33527 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
|  |  | diphtheriae, Listeria monocytogenes, Listeria monocytogenes, Pseudomonas fluorescens, Pseudomonas fluorescens, Pseudomonas syringae, Staphylococcus saprophyticus | Q71WH7, Q3K506, Q4K441, Q87UI3, Q49ZE0 |  |
| 1271 | LSGGQKQRVA | Lactobacillus sakei, Lactobacillus salivarius, Lactobacillus delbrueckii, Enterococcus faecalis, Staphylococcus epidermidis, Staphylococcus epidermidis, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Streptococcus mutans, Streptococcus agalactiae, Streptococcus agalactiae, Streptococcus agalactiae, Streptococcus sanguinis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes | Q38UT9, Q1WSB8, Q1GBJ0, Q839D5, Q8CQ57, Q5HRU5, Q8CRI6, Q5HM27, Q5HDY6, Q2FW34, Q2FER7, Q8NVB5, Q6G799, Q99S47, Q7A470, Q6GEL3, Q8NY21, Q6GC27, Q6GJL2, Q2YYM4, Q7A7E3, Q99WE1, Q2YVT7, Q8DRR9, Q8DWR3, Q3JYF4, Q8E2L2, A3CRB9, Q1J982, P0C0E9, P0CZ29, Q1J449, A2RH11, Q1JEC8, Q7CMM7, P0CZ28, Q5X9B5, Q48QM2, Q1JJC9, P0C0E8 | Q9NP78 |
| 1272 | LSGGQKQRVS | Enterococcus faecalis | Q832R5 | P33527 |
| 1273 | LSGGQRQRI | Acinetobacter baylyi, Bacillus halodurans, Pseudomonas aeruginosa, Pseudomonas syringae, Pseudomonas putida | Q6F9A8, Q9K876, Q03024, Q88AS5, Q88CL2 | O60706 |
| 1274 | LSGGQRQRV | Bacillus subtilis, Escherichia coli, Rhizobium etli, Rhizobium loti, Rhizobium meliloti, Rhizobium leguminosarum, Rhizobium leguminosarum | P94360, Q8FKF5, Q2K4V4, Q98G42, Q9Z3R9, Q1MCN6, Q1MFL8 | Q15438 |
| 1275 | LSGGVDSAVAA | Uncultured termite | B1GZY9 | O75648 |
| 1276 | LSGGVDSTV | Desulfovibrio maeticus | C4XSN8 | P49915 |
| 1277 | LSGHTHAGQIFP | Helicobacter pylori, Helicobacter pylori | O25685, Q9ZM43 | Q6ZT21 |
| 1278 | LSGPSGAGKSTL | Helicobacter pylori, Helicobacter pylori, Helicobacter pylori | P56103, Q1CUI1, Q9ZMB7 | Q16774 |
| 1279 | LSIPVIANG | Haemophilus influenzae | P44606 | Q9NX74 |
| 1280 | LSMANAGPNTNGSQFF | Staphylococcus haemolyticus | Q4L4W9 | A0A0B4J2A2 |
| 1281 | LSMANAGPNTNGSQFFI | Staphylococcus epidermidis, Staphylococcus epidermidis, Streptococcus pyogenes | Q5HQK8, Q8CT84, Q5XAQ1 | A0A0B4J2A2 |
| 1282 | LSMFPYPSG | Aeromonas salmonicida, Aeromonas hydrophila, Arcobacter butzleri, Campylobacter hominis, Campylobacter lari, Campylobacter curvus, Haemophilus somnus, Haemophilus influenzae, | A4SJW8, A0KN87, A8ERV3, A7I0M0, B9KCS8, A7GZ81, Q0I5C5, A5UDF4, Q4QLY8, P43827, A5UI62, Q7VIY7 | Q15031 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Haemophilus influenzae, Haemophilus influenzae, Haemophilus influenzae, Helicobacter hepaticus* | | |
| 1283 | LSMFPYPSGKLH MGHVR | *Acinetobacter baylyi, Acinetobacter baumannii, Acinetobacter baumannii, Acinetobacter baumannii, Acinetobacter baumannii, Acinetobacter baumannii, Neisseria meningitidis, Neisseria gonorrhoeae, Neisseria gonorrhoeae, Neisseria meningitidis, Neisseria meningitidis, Neisseria meningitidis, Pseudomonas syringae, Pseudomonas entomophila, Pseudomonas putida, Pseudomonas putida, Pseudomonas putida, Pseudomonas putida, Pseudomonas syringae, Pseudomonas fluorescens, Pseudomonas savastanoi, Pseudomonas fluorescens, Pseudomonas aeruginosa, Pseudomonas aeruginosa, Pseudomonas aeruginosa, Pseudomonas aeruginosa, Pseudomonas fluorescens, Pseudomonas mendocina, Pseudomonas stutzeri* | Q6F817, B0VKP9, B0V5H2, B2HTC4, B7I5I5, B7H051, A9M162, Q5FAJ3, B4RNT1, Q9JW39, Q9JXT2, A1KS07, Q4ZN90, Q1I4G7, B0KJW8, Q88DN1, A5W9H9, B1J150, Q87VX3, Q4K5H6, Q48DN1, C3K2L2, A6V0C2, Q9HX33, B7V9C9, Q025F5, Q3K6B0, A4XYW8, A4VQZ0 | Q15031 |
| 1284 | LSPNGGGEP | *Bacillus caldotenax, Bacillus subtilis* | P28760, P54375 | P04179 |
| 1285 | LSQSGETAD | *Streptococcus agalactiae, Streptococcus agalactiae, Streptococcus pyogenes, Streptococcus pyogenes, Streptococcus pyogenes, Streptococcus pyogenes, Streptococcus mutans, Streptococcus pyogenes* | Q8DZZ7, Q8E5P8, Q8P057, P0DB32, P0DB33, Q99ZD3, Q8DTY0, Q5XBV6 | Q06210 |
| 1286 | LSQSGETADTL | *Clostridium perfringens, Clostridium acetobutylicum, Escherichia coli, Escherichia coli, Escherichia coli, Haemophilus influenzae* | Q8XHZ7, Q97MN6, Q8FBT4, P17169, Q8XEG2, P44708 | Q06210 |
| 1287 | LSVAVYNHYKR | *Bifidobacterium longum, Corynebacterium efficiens* | Q8G5R1, Q8FN57 | O76031 |
| 1288 | LSVAVYNHYKRI | *Propionibacterium acnes* | Q6A7F1 | O76031 |
| 1289 | LTASAGIAPN | *Stenotrophomonas maltophilia, Stenotrophomonas maltophilia* | B4SIF5, B2FLR2 | Q9UBT6 |
| 1290 | LTDYGFEGHP | *Methylobacterium sp., Methylobacterium radiotolerans, Methylobacterium populi, Methylobacterium extorquens, Rhizobium loti* | B0ULK6, B1LUN5, B1ZA44, A9W1N1, Q98KQ7 | O75489 |
| 1291 | LTIRLALGG | *Pseudomonas fluorescens, Pseudomonas fluorescens, Pseudomonas fluorescens, Pseudomonas syringae, Pseudomonas syringae, Pseudomonas savastanoi* | C3K1H1, Q4KHQ8, Q3KHJ4, Q886V2, Q4ZWY9, Q48LW0 | Q9Y3D3 |
| 1292 | LTPTRELAVQVK | *Bacillus subtilis* | P42305 | Q9GZR7 |
| 1293 | LTPVTLELGGKSP | *Pseudomonas aeruginosa* | Q9I6C8 | P51648 |
| 1294 | LTRLDHNRA | *Kocuria rhizophila* | B2GKC8 | P40925 |
| 1295 | LTRLDHNRAK | *Propionibacterium acnes* | Q6A6Z5 | P40925 |
| 1296 | LTTGTFLRG | *Bacillus licheniformis, Rhizobium leguminosarum, Rhizobium etli* | Q65CN2, Q1MA19, Q2K2S1 | Q9Y2Z2 |
| 1297 | LTYPLIGNYGI | *Bacillus subtilis, Bacillus halodurans, Fusobacterium nucleatum* | P25993, Q9K9V8, Q8RG87 | P27708 |
| 1298 | LVDDSIVRG | *Pseudomonas aeruginosa, Staphylococcus aureus, Staphylococcus aureus, Staphylococcus aureus, Staphylococcus aureus, Staphylococcus aureus* | Q51342, P99164, P65831, Q8NX91, Q5HH14, Q6GAE3, Q6GI14 | Q06203 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1299 | LVDGKDVMP | Rhizobium leguminosarum, Rhizobium meliloti | Q1MM06, Q92SC4 | P06744 |
| 1300 | LVDGKDVMPEVN | Haemophilus influenzae, Haemophilus influenzae, Haemophilus influenzae, Haemophilus influenzae | Q4QL07, A5UCG6, A5UED2, P44312 | P06744 |
| 1301 | LVEFMASGP | Streptomyces avermitilis | Q82CA0 | O75414 |
| 1302 | LVEVNCETDFV | Neisseria meningitidis, Neisseria meningitidis, Neisseria meningitidis, Neisseria meningitidis, Neisseria gonorrhoeae | A1KWH7, A9M490, P64051, P64050, Q5F5F4 | P43897 |
| 1303 | LVEVNCETDFVS | Ralstonia pickettii | B2UB07 | P43897 |
| 1304 | LVGDVDFEGV | Methylobacterium extorquens | Q9X7F6 | P13995 |
| 1305 | LVGGASLKP | Clostridium phytofermentans | A9KPF8 | P60174 |
| 1306 | LVGGFGLCGIPE | Helicobacter pylori, Helicobacter pylori | Q9ZLE3, P56006 | P55809 |
| 1307 | LVGGSTRIP | Enterococcus faecalis, Listeria welshimeri, Listeria monocytogenes, Listeria monocytogenes, Listeria monocytogenes, Listeria monocytogenes, Listeria monocytogenes, Listeria innocua, Streptococcus mutans, Streptococcus pneumoniae, Streptococcus pneumoniae, Streptococcus pneumoniae, Streptococcus pneumoniae, Streptococcus pneumoniae, Streptococcus pneumoniae, Streptococcus thermophilus, Streptococcus thermophilus, Streptococcus pneumoniae, Streptococcus pneumoniae, Streptococcus thermophilus, Streptococcus equi, Streptococcus equi | Q835R7, A0AIS4, B8DE38, P0DJM2, G2K046, Q71ZJ7, C1KVC0, Q92BN8, O06942, B2IMB5, C1CQ18, C1CJ06, Q8CVVT3, B1IA52, C1C5N7, Q04LY0, Q03MR6, Q5M1T8, C1CCQ8, P95829, B8ZLY9, Q5M6D1, C0ME86, C0M7T9 | P48723 |
| 1308 | LVIFPEGTR | Helicobacter pylori, Helicobacter pylori | O25903, Q9ZJN8 | Q9NUQ2 |
| 1309 | LVLEVAQHLGE | Geobacter lovleyi, Geobacter sulfurreducens, Geobacter daltonii, Geobacter metallireducens, Geobacter sp., Geobacter bemidjiensis, Geobacter uraniireducens | B3EA01, Q74GY0, B9LZ84, Q39Q56, C6E9F1, B5EFI7, A5G9D8 | P06576 |
| 1310 | LVLTHFSQRY | Streptomyces avermitilis, Streptomyces coelicolor, Streptomyces griseus | Q82BX8, Q9RDE4, B1VY42 | Q9H777 |
| 1311 | LVLTKPLGT | Geobacter sulfurreducens | Q74FK1 | P49903 |
| 1312 | LVLTPTRELA | Haemophilus influenzae | P44701 | Q9GZR7 |
| 1313 | LVLTPTRELAVQVK | Bacillus cereus | Q81412 | Q9GZR7 |
| 1314 | LVNIFGGIV | Aeromonas salmonicida, Aeromonas hydrophila, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus somnus, Klebsiella pneumoniae, Klebsiella pneumoniae, Proteus mirabilis, Pseudomonas mendocina, Pseudomonas stutzeri | A4SND2, A0KJK9, C5BEM7, A4W879, B7M5P1, B6I7Z9, B7N9W6, B1LLG1, P0A837, P0A836, B1IY02, A7ZXY8, B1X6Q8, C4ZWK2, P0A838, B7NMS9, B5YQR7, B7LAD4, A7ZJA8, Q0I3A8, A6T6F6, B5XZD1, B4ESR1, A4XV90, A4VKQ1 | Q96I99 |
| 1315 | LVPIGRGQREL | Lactobacillus salivarius, Lactobacillus delbrueckii, Lactobacillus delbrueckii, Enterococcus faecalis, Enterococcus hirae, Streptococcus mutans | Q1WUC8, Q04BA5, Q1GAW7, Q831A3, P26679, P95787 | P25705 |
| 1316 | LVPIGRGQRELIIGD | Helicobacter pylori, Helicobacter pylori, Helicobacter pylori, | P55987, B6JMX4, B5Z8D2, B2UUP2, | P25705 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Helicobacter pylori, Helicobacter acinonychis, Helicobacter pylori, Helicobacter pylori* | Q17Y80, Q1CSD3, Q9ZK79 | |
| 1317 | LVPIGRGQRELIIG DR | *Lactobacillus plantarum, Lactobacillus reuteri, Lactobacillus reuteri, Lactobacillus sakei, Lactobacillus casei, Lactobacillus casei, Lactobacillus fermentum, Lactobacillus gasseri, Lactobacillus johnsonii, Lactobacillus helveticus, Lactobacillus acidophilus, Lactobacillus brevis, Leuconostoc mesenteroides, Leuconostoc citreum, Pediococcus ntosaceus* | Q88UU1, B2G689, A5VIQ9, Q38WK3, Q03A20, B3WDL6, B2GAU3, Q042L3, Q74K17, A8YUJ9, Q5FKY2, Q0Q0Y6, Q03V27, B1MW87, Q03EL2 | P25705 |
| 1318 | LVPIGRGQRELIIG DRQTGKT | *Arcobacter butzleri, Bacillus cytotoxicus, Bacillus cereus, Bacillus thuringiensis, Bacillus cereus, Bacillus cereus, Bacillus cereus, Bacillus cereus, Bacillus anthracis, Bacillus anthracis, Bacillus thuringiensis, Bacillus anthracis, Bacillus cereus, Bacillus weihenstephanensis, Bacillus cereus, Bacillus cereus, Campylobacter concisus, Campylobacter fetus, Campylobacter curvus, Campylobacter jejuni, Campylobacter jejuni, Campylobacter jejuni, Campylobacter hominis, Campylobacter jejuni, Campylobacter jejuni, Campylobacter lari, Helicobacter hepaticus, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae* | A8EV72, A7GV58, C1F0N0, Q6HAX7, B9IRT9, B7HY67, Q72XE6, Q630U1, B7JGN2, C3LFI1, Q81JZ3, A0RL97, C3P1F6, Q814W0, A9VSA5, B7IQW0, B7HFK4, A7ZC35, A0RR28, A7H0I9, A8FJR0, Q5HX61, Q9PJ21, A7I175, A1VXI8, A7H1H9, B9KES1, Q7VJ23, Q8CNJ5, Q5HMB7, Q4L7Y6, A5IUQ0, P63675, A7X4U5, P99111, P63676, A8YY72, Q6G7K5, Q6GEX0, Q2FF22, A6U3J0, Q2FWE8, Q2YUJ9, Q5HE95, A6QIU9, Q49Z52, C1CLK8, B5E673, C1CF95, B8ZLB1, B2IQX2, C1C8A1, Q7CRB1, Q97PT4, C1CSD0, B1ICT1 | P25705 |
| 1319 | LVPIGRGQRELIIG DRQTGKTS | *Bacillus megaterium, Bacillus sp., Listeria monocytogenes, Listeria monocytogenes, Listeria innocua, Listeria welshimeri, Streptococcus thermophilus, Streptococcus thermophilus, Streptococcus thermophilus, Streptococcus agalactiae, Streptococcus agalactiae, Streptococcus agalactiae, Streptococcus uberis* | P17674, P09219, Q71WP7, Q8Y4CO3 Q927W2, A0ALL5, Q5M106, Q03LX5, Q5M5J3, Q8E5V0, Q8E074, Q3K1J7, B9DRT4 | P25705 |
| 1320 | LVQLPLPEH | *Pseudomonas mendocina* | A4XTZ3 | P13995 |
| 1321 | LVQLPLPEHI | *Haemophilus ducreyi* | Q7VM86 | P13995 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1322 | LVQLPLPEHID | Streptococcus sanguinis | A3CLQ4 | P13995 |
| 1323 | LVSGGTDNHLVLV | Campylobacter fetus | A0RQ16 | P34897 |
| 1324 | LVTGGAGFI | Escherichia coli, Escherichia coli, Escherichia coli, Neisseria meningitidis, Neisseria meningitidis, Neisseria gonorrhoeae, Rhizobium sp., Streptomyces niveus | P55293, P37759, Q6E7F4, P55294, Q9S642, P37761, P55462, Q9L9E8 | O95455 |
| 1325 | LVTGGAGYIGSHT | Bacillus subtilis | P55180 | Q14376 |
| 1326 | LVTGGAGYIGSHTV | Haemophilus influenzae | P24325 | Q14376 |
| 1327 | LVTGGAGYIGSHTVL | Bacillus halodurans | Q9KDV3 | Q14376 |
| 1328 | LWIDSVAA | Desulfovibrio vulgaris, Desulfovibrio vulgaris, Streptococcus uberis, Streptococcus gordonii | A1VEQ5, P62214, B9DW65, P49986 | Q43542 |
| 1329 | LWDAIVIGAG | Rhizobium meliloti | Q92XP4 | Q9P0Z9 |
| 1330 | LWEAQFGDF | Bacillus halodurans, Bacillus clausii | Q9KAT1, Q5WG56 | Q96HY7 |
| 1331 | LYAEQLSGS | Rhizobium leguminosarum, Rhizobium etli, Rhizobium leguminosarum, Rhizobium etli, Rhizobium meliloti, Rhizobium sp., Rhizobium loti | QIM152, Q2K9E5, B5ZZA8, B3PWZ9, Q9X4F5, C3M930, Q983J4 | Q93099 |
| 1332 | LYAEQLSGSAFT | Streptomyces avermitilis | Q828S5 | Q93099 |
| 1333 | LYDTYGFPV | Streptococcus pneumoniae, Streptococcus pneumoniae, Streptococcus pneumoniae, Streptococcus pneumoniae, Streptococcus pneumoniae, Streptococcus mutans, Streptococcus gordonii, Streptococcus thermophilus, Streptococcus pyogenes, Streptococcus pyogenes, Streptococcus pyogenes, Streptococcus thermophilus, Streptococcus thermophilus, Streptococcus pyogenes, Streptococcus agalactiae, Streptococcus pyogenes, Streptococcus pyogenes, Streptococcus pyogenes, Streptococcus pyogenes, Streptococcus pyogenes, Streptococcus agalactiae, Streptococcus pyogenes, Streptococcus agalactiae, Streptococcus pyogenes | B2IQK0, Q8DPC7, Q04JW5, Q97Q48, B1ICI3, Q8CVVY0, A8AYI8, Q03LZ8, Q99Z57, P0DG25, P0DG24, Q5M5L5, Q5M126, Q1JG77, Q8E600, Q48SS4, Q1JL53, Q1JB08, Q5XBH1, Q1J5Z4, Q8E0C4, Q8P0E6, Q3K1P7, A2RDY3 | P49588 |
| 1334 | LYMTRIQKERF | Clostridium botulinum, Clostridium botulinum | B2TNG3, B2UW93 | P27708 |
| 1335 | LYVRRVFITD | Geobacter metallireducens | Q39SQ3 | P14625 |
| 1336 | LYWLSGLTC | Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli | Q1R9R8, A1AD14, B1IY65, P33018, A8A215, B1X7P2, Q8FFU3, Q0TFT6, Q8X635, A7ZNX7, Q8FKG2, B1LKQ1, Q0TKS8, Q1RFI8, A1A834, A7ZIA3, A7ZX03, B1LIP0, Q8X5J5, B1J086, B1XEU8, P51025 | P10768 |
| 1337 | MALPPCHAL | Bifidobacterium longum, Neisseria meningitidis, Neisseria meningitidis, Neisseria meningitidis, Neisseria gonorrhoeae, Pseudomonas aeruginosa, Pseudomonas aeruginosa, Pseudomonas aeruginosa, Pseudomonas mendocina, Pseudomonas stutzeri | Q8G3T9, A1KVB3, Q9JY72, Q9JT57, Q5F732, B7V2Q5, Q02U73, Q9I6F1, A6UYE6, A4Y044, A4VGL9 | P04818 |
| 1338 | MAQIGCFVP | Bacillus cytotoxicus, Bacillus subtilis, Lactobacillus reuteri, Lactobacillus reuteri, Bacillus methylotrophicus, | A7GR99, P49849, B2G6E5, A5VIW9, A7Z4X5, Q04505, | P43246 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Lactobacillus gasseri, Lactobacillus plantarum, Enterococcus faecalis* | Q88UZ7, Q82ZA2 | |
| 1339 | MASGPVVAMV | *Streptomyces coelicolor* | P50589 | Q13232 |
| 1340 | MEALNVLPP | *Bacteroides vulgatus, Bacteroides fragilis, Bacteroides fragilis* | A6KZ38, Q64ZY1, Q5LIT7 | P49589 |
| 1341 | MGCSNPHPH | *Escherichia coli* | P09148 | P07902 |
| 1342 | MGGQTALNC | *Escherichia coli, Escherichia coli, Escherichia coli, Haemophilus ducreyi, Neisseria meningitidis, Neisseria meningitidis, Pseudomonas aeruginosa, Pseudomonas syringae, Pseudomonas putida, Ralstonia solanacearum* | Q8FLB0, P63737, P00968, Q7VP67, Q9JXW8, Q9JW02, P38100, Q87WP4, Q88DU6, Q8XZ83 | P31327 |
| 1343 | MGHGDEIVL | *Haemophilus parasuis* | B8F6Y2 | A2VDF0 |
| 1344 | MGHGDEIVLAD | *Haemophilus influenzae, Haemophilus influenzae, Haemophilus influenzae, Haemophilus influenzae* | Q4QMI4, A5UAS6, P44778, A5UHL6 | A2VDF0 |
| 1345 | MGHVDHGKT | *Desulfitobacterium hafniense, Bifidobacterium adolescentis, Bifidobacterium longum, Bifidobacterium longum, Bifidobacterium longum, Eubacterium eligens, Bifidobacterium animalis, Propionibacterium acnes, Bacteroides vulgatus, Bacteroides thetaiotaomicron, Parabacteroides distasonis, Bacteroides fragilis, Bacteroides fragilis, Clostridium botulinum, Clostridium botulinum, Clostridium botulinum, Clostridium botulinum, Clostridium botulinum, Clostridium botulinum, Clostridium botulinum, Clostridium botulinum, Clostridium kluyveri, Clostridium botulinum, Clostridium tetani, Clostridium perfringens, Clostridium perfringens, Clostridium perfringens, Clostridium novyi, Clostridium botulinum, Clostridium beijerinckii, Clostridium acetobutylicum, Clostridium cellulolyticum, ptoclostridium difficile, Corynebacterium diphtheriae, Corynebacterium efficiens, Kocuria rhizophila, Neisseria meningitidis, Neisseria meningitidis, Neisseria meningitidis, Neisseria meningitidis, Neisseria gonorrhoeae, Neisseria gonorrhoeae, Porphyromonas gingivalis, Porphyromonas gingivalis, Pseudomonas mendocina, Pseudomonas aeruginosa, Pseudomonas aeruginosa, Pseudomonas aeruginosa, Pseudomonas aeruginosa, Pseudomonas fluorescens, Pseudomonas fluorescens, Pseudomonas stutzeri, Pseudomonas fluorescens, Pseudomonas entomophila, Pseudomonas putida, Pseudomonas putida, Pseudomonas putida, Pseudomonas syringae, Pseudomonas syringae, Pseudomonas savastanoi, Pseudomonas putida, Ralstonia pickettii, Ralstonia solanacearum, Streptomyces griseus, Streptomyces avermitilis, Streptomyces coelicolor* | Q24UI6, A1A0A2, Q8G3Y5, B3DQF0, B7GNA3, C4Z5N7, B8DW43, Q6A7M5, A6L030, Q8A2A1, A6LHS1, Q64ZR4, Q5LIN1, A7GG06, B1I149, C3L0B6, A5I4J3, A7FVZ3, C1FS59, B1KWK7, A5N842, B2TJ55, Q895J8, Q0SSD4, Q8XJR8, Q0TPR7, A0Q0Q7, B2V4G9, A6LSQ4, Q97I51, B8I6E7, Q18BH4, Q6NGN2, Q8FPA7, B2GKR5, A9M1D5, A1KV51, Q9JYD2, Q9JTB5, B4RMZ3, Q5F797, Q7MXE4, B2RHM9, A4XYE0, A6VCK1, Q9HV55, B7V1F6, Q02FS8, Q3KI84, Q4KIF6, A4VPP0, C3K259, Q1IF43, B0KHX8, A5W987, Q88DV7, Q4ZNR2, Q87WQ5, Q48E77, B1J2A9, B2UAA3, Q8XZV6, B1VYN5, Q82K53, Q8CJQ8 | P46199 |
| 1346 | MGHVDHGKTTLLDK | *Lactobacillus reuteri, Lactobacillus reuteri* | B2G6V6, A5VJE0 | P46199 |
| 1347 | MGKIDKKAL | *Streptomyces carzinostaticus* | Q84HC5 | Q4G176 |
| 1348 | MGPLGSPLS | *Streptomyces coelicolor* | Q93JL5 | P35558 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1349 | MGVSGSGKS | Escherichia coli | P46859 | Q5T6J7 |
| 1350 | MIRPRGGDF | Streptococcus pyogenes | Q5XDL5 | Q9NTM9 |
| 1351 | MITASHNPK | Staphylococcus epidermidis, Staphylococcus epidermidis | Q5HLD2, Q8CN38 | Q96G03 |
| 1352 | MITGDNPLT | Clostridium perfringens | Q0TRT3 | Q9HD20 |
| 1353 | MKSVGEVMA | Neisseria gonorrhoeae | Q59599 | P31327 |
| 1354 | MKSVGEVMAIGRTF | Campylobacter jejuni, Rhizobium loti, Rhizobium meliloti | Q9PIL7, Q98I87, Q92PZ4 | P31327 |
| 1355 | MKVRGAPAI | Bacillus cereus, Bacillus cereus, Bacillus anthracis, Bacillus thuringiensis, Bacillus weihenstephanensis, Bacillus thu ring iensis | Q81IK7, Q63GN3, Q81ZC2, A0R946, A9VRK3, Q6HP54 | Q9BV20 |
| 1356 | MLACARIGA | Helicobacter pylori, Helicobacter pylori | Q1CUA3, B6JKX8 | Q9NUB1 |
| 1357 | MLLLDEPTNHLD | Escherichia coli, Escherichia coli, Haemophilus influenzae | P0A9W3, P0A9W4, P45127 | Q9UG63 |
| 1358 | MLQQTQVATVI | Aeromonas hydrophila | P46230 | Q9UIF7 |
| 1359 | MLTGESIPV | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q2YWA3, Q8NUQ9, Q6G6B7, Q7A3E6, Q99R80, A6U4T8, A5IVY3, A7X651, A8Z3F8, A6QK47, Q5HCZ3, Q2FDV0, Q2FV64, Q6GDP1, Q8CN02, Q5HL56 | Q4VNC0 |
| 1360 | MPTGGGKSLCYQ | Escherichia coli | P15043 | P54132 |
| 1361 | MQEEIFGPV | Bacillus subtilis | P39634 | P30838 |
| 1362 | MQKEIFEQP | Haemophilus ducreyi | Q7VKK4 | Q06210 |
| 1363 | MRQAGRYLP | Geobacter daltonii, Geobacter uraniireducens, Geobacter sp., Geobacter bemidjiensis | B9M7T4, A5GDW7, C6E7R9, B5E7R1 | P06132 |
| 1364 | MRQAGRYLPE | Acinetobacter baylyi, Acinetobacter baumannii, Acinetobacter baumannii, Acinetobacter baumannii, Acinetobacter baumannii, Acinetobacter baumannii, Acinetobacter baumannii, Aeromonas salmonicida, Arcobacter butzleri, Campylobacter lari, Campylobacter fetus, Campylobacter jejuni, Campylobacter jejuni, Campylobacter jejuni, Campylobacter jejuni, Campylobacter jejuni, Campylobacter concisus, Campylobacter hominis, Campylobacter curvus, Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Geobacter metallireducens, Geobacter sulfurreducens, Geobacter lovleyi, Haemophilus somnus, Klebsiella pneumoniae, Klebsiella pneumoniae, Proteus mirabilis, Pseudomonas | Q6F9M1, A3M795, B0VBT2, B7GZK6, B7I451, B2HVF8, B0VUQ9, A45J51, A8EVQ3, B9KFM9, A0RQV9, Q5HTL9, A8FMU8, A1WOM7, Q9PN54, A7H2D8, A7ZEJ7, A7I2S8, A7GZU8, A8AKS6, C5BHE8, A4W5C0, B7N2J9, Q1R5W3, Q8FB74, A1AIG8, B7UPF2, B7MIY3, B7NRT0, B6I5K8, B1LNU9, B7NFT8, P29680, B1IUQ0, A8A797, C5A0T8, B1XC00, B7M7Q6, A7ZUL3, B5Z093, Q8X6X5, Q0TA68, B7LA91, B7LUK5, Q39Z08, Q746R5, B3EAR8, Q0I5E2, A6TGQ4, B5XYE1, B4EYT8, Q87V23, Q48PG2, Q4ZZD8, B1J2J9, Q88CV6, B0KN28, Q1IGA3, A5WAA7, Q3KJ97, Q4KJI4, C3KBH3, B7V3C7, A6VDF5, | P06132 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | syringae, Pseudomonas savastanoi, Pseudomonas syringae, Pseudomonas putida, Pseudomonas putida, Pseudomonas putida, Pseudomonas entomophila, Pseudomonas putida, Pseudomonas fluorescens, Pseudomonas fluorescens, Pseudomonas fluorescens, Pseudomonas aeruginosa, Pseudomonas aeruginosa, Pseudomonas aeruginosa, Pseudomonas aeruginosa, Pseudomonas mendocina, Ralstonia pickettii, Ralstonia solanacearum, Rhizobium leguminosarum, Rhizobium sp., Rhizobium loti, Sphingomonas wittichii | P95458, Q02EY3, A4XPQ6, B2UGT5, Q8XU90, Q1MA15, C3MB70, Q98DY6, A5VA70 | |
| 1365 | MRVDFNVPMK | Fusobacterium nucleatum | Q8RFN7 | P07205 |
| 1366 | MTFGLACCA | Rhizobium etli | Q2K755 | O75251 |
| 1367 | MTFGLACCAVEM | Rhizobium loti, Sphingomonas wittichii | Q98KQ6, A5VAL8 | O75251 |
| 1368 | MTFGLACCAVEMM | Methylobacterium sp., Methylobacterium nodulans, Methylobacterium extorquens, Methylobacterium radiotolerans, Methylobacterium extorquens, Methylobacterium populi, Rhizobium meliloti, Rhizobium leguminosarum, Rhizobium leguminosarum, Rhizobium etli, Rhizobium etli | B0ULK5, B8IUU7, B7K065, B1LUN6, A9Q1N2, B1ZA45, O68853, B5ZYL3, Q1MIL4, Q2K9T4, B3PVZ8 | O75251 |
| 1369 | MTVEPGFGGQ | Streptomyces coelicolor | Q9L0Z5 | Q96AT9 |
| 1370 | MVYVRGHAED | Rhizobium etli, Rhizobium leguminosarum, Rhizobium leguminosarum, Rhizobium sp., Rhizobium etli | Q2KB43, B5ZUG2, Q1MJU4, C3MIE4, B3PTE0 | Q8NE62 |
| 1371 | MYCTGGIRCE | Citrobacter koseri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Rhizobium leguminosarum, Rhizobium etli, Rhizobium leguminosarum, Rhizobium meliloti, Rhizobium sp. | A8A124, A4W968, B7LT80, B5YVS5, Q8X8P2, Q8FIR7, Q0TJ18, B1IV47, A7ZZ13, P24188, B1X9G8, C4ZRZ5, B7M930, B7NL80, B7LFG6, A7ZKF9, B1LIV6, A1A9V1, B7MIJ6, B6I9D2, B7NAT1, B7MTI7, B7UP69, B5XXK0, B5ZQU6, Q2K443, Q1MBM8, Q92LX6, C3M8W9 | Q5T7W7 |
| 1372 | MYGQMTAGS | Acinetobacter baumannii, Acinetobacter baumannii, Acinetobacter baumannii, Acinetobacter baumannii, Acinetobacter baumannii, Bacillus halodurans, Bacillus weihenstephanensis, Bacillus cytotoxicus, Bacillus cereus, Bacillus anthracis, Bacillus anthracis, Bacillus anthracis, Bacillus cereus, Bacillus cereus, Bacillus thuringiensis, Bacillus cereus, Bacillus cereus, Bacillus cereus, Bacillus thuringiensis, Bacillus cereus, Bacillus cereus, Bacillus cereus, Bacillus methylotrophicus, Bacillus subtilis, Citrobacter koseri, Enterobacter sp., Klebsiella pneumoniae, Klebsiella pneumoniae, Methylobacterium nodulans, Pseudomonas fluorescens, | B2I2C4, B0V9X6, B7I271, B7GUU5, B0VPV2, Q9KBE5, A9VPT7, A7GQZ9, B7J179, Q81Y46, C3L983, C3P4M1, Q637H9, C1EN92, A0RH38, B7ISJ1, B7HCC9, Q733H9, Q6HFF0, B9IUG9, B7HKJ0, Q81AC7, A7ZAE5, P25503, A8AJ16, A4W8B4, A6T6L0, B5XZ80, B8II06, C3K803, B1J2Q5, Q9HU83, B7V3J3, Q02ER6, Q88CZ6, A5WA67, Q1I3Q8, B0KM58, A6VDL7, Q87UM6, | Q96N76 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Pseudomonas putida, Pseudomonas aeruginosa, Pseudomonas aeruginosa, Pseudomonas aeruginosa, Pseudomonas putida, Pseudomonas putida, Pseudomonas entomophila, Pseudomonas putida, Pseudomonas aeruginosa, Pseudomonas syringae, Pseudomonas syringae, Pseudomonas putida, Pseudomonas savastanoi, Pseudomonas syringae, Ralstonia solanacearum, Rhizobium meliloti, Rhizobium loti, Sphingomonas wittichii, Staphylococcus aureus, Staphylococcus aureus, Staphylococcus aureus, Staphylococcus aureus, Staphylococcus aureus, Staphylococcus aureus, Staphylococcus saprophyticus, Stenotrophomonas maltophilia, Stenotrophomonas maltophilia* | Q4ZLW7, P25080, Q48CE0, Q9AGU4, Q8XW28, Q92V80, Q983H8, A5VFA2, P67418, Q6G6Y9, Q5HDM6, P67417, Q6GEA4, Q931G1, Q49ZQ7, B4SP57, B2FKG1 | |
| 1373 | MYTSGSTGRPKGVM | *Bacillus subtilis* | O31827 | O60488 |
| 1374 | NANGVDLNRNFP | *Escherichia coli, Escherichia coli* | P0ACV6, P0ACV7 | P15169 |
| 1375 | NASGINDGAA | *ptoclostridium difficile, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q18AR0, Q5HIU0, Q2YVF5, Q2FJQ9, Q2G124, Q6GJW4, Q8NY95, Q6GCB8, Q99WM3, Q7A7L2 | Q9BWD1 |
| 1376 | NASGINDGAAA | *Haemophilus influenzae, Staphylococcus epidermidis, Staphylococcus epidermidis* | P44873, Q8CQN7, Q5HS07 | Q9BWD1 |
| 1377 | NASGINDGAAAV | *Acinetobacter baylyi, Acinetobacter baylyi* | Q43974, Q43935 | Q9BWD1 |
| 1378 | NASRTMLFNIH | *Lactobacillus salivarius, Lactobacillus plantarum, Clostridium tetani* | Q1WVJ0, Q88ZF1, Q891B8 | Q14409 |
| 1379 | NASTRFSDG | *Eubacterium rectale, Eubacterium eligens, Helicobacter hepaticus* | C4Z9V4, C4Z075, Q7VI05 | P54886 |
| 1380 | NCETDFVSRN | *Ralstonia solanacearum* | Q8XZJ0 | P43897 |
| 1381 | NCNPETVSTD | *Helicobacter pylori, Helicobacter pylori* | Q9ZKT2, O25577 | P31327 |
| 1382 | NDAFGTAHR | *Lactobacillus fermentum* | B2GAL8 | P07205 |
| 1383 | NDAFGTAHRAH | *Leuconostoc mesenteroides, Leuconostoc citreum* | Q03UX8, B1MW69 | P07205 |
| 1384 | NDNLMELLIMI | *Lactobacillus plantarum, Clostridium tetani, Enterococcus faecalis* | Q88Z84, Q899I8, Q82ZA5 | P11908 |
| 1385 | NERLEFLGD | *Clostridium botulinum, Clostridium botulinum, Clostridium beijerinckii, Clostridium tetani, Clostridium perfringens, Corynebacterium diphtheriae, Haemophilus parasuis, Haemophilus ducreyi, Streptomyces avermitilis, Streptomyces coelicolor* | B2V4D6, B2TJ22, A6LSM2, Q895M9, Q8XJN8, Q6NGH3, B8F3C7, Q7VL75, Q82JT9, Q9ZBQ7 | Q9NRR4 |
| 1386 | NERLEFLGDA | *Bacteroides thetaiotaomicron* | Q8A2E8 | Q9NRR4 |
| 1387 | NERLEFLGDAV | *Arcobacter butzleri, Bacillus methylotrophicus, Bacillus licheniformis, Bacillus subtilis, Bacillus weihenstephanensis, Bacillus halodurans, Bacillus cereus, Bacillus cereus, Bacillus cereus, Bacillus thuringiensis, Bacillus cereus, Bacillus anthracis, Bacillus cereus, Bacillus anthracis, Bacillus anthracis, Bacillus cereus, Bacillus cereus, Bacillus cereus, Bacillus cereus, Bacillus* | A8EV88, A7Z4L3, Q65JQ5, P51833, A9VT87, Q9KA05, Q819V8, B7IUK8, B7HDX2, Q6HEW6, C1EP73, C3P5Q0, B7JJT6, Q81WI8, C3L778, B9IVD8, B7HLI2, Q732M1, Q636H7, A7GRH9, Q38XR8, Q5WFM6, | Q9NRR4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | cytotoxicus, Lactobacillus sakei, Bacillus clausii, Campylobacter jejuni, Campylobacter jejuni, Campylobacter jejuni, Campylobacter jejuni, Campylobacter concisus, Campylobacter fetus, Campylobacter curvus, Clostridium acetobutylicum, Corynebacterium jeikeium, Corynebacterium efficiens, Corynebacterium glutamicum, Enterococcus faecalis, Helicobacter pylori, Helicobacter hepaticus, Helicobacter pylori, Helicobacter pylori, Helicobacter pylori, Helicobacter acinonychis, Helicobacter pylori, Listeria monocytogenes, Listeria welshimeri, Listeria monocytogenes, Listeria monocytogenes, Listeria monocytogenes, Listeria innocua | Q9PM40, A8FNU7, A7H5Y2, Q5HSF8, A8Z6F6, A0RRM7, A7H186, Q97IA4, Q4JUY7, Q8FP16, Q8NNV6, Q82ZG1, B6JLQ0, Q7VIA9, Q9ZLH2, P56118, B5Z735, Q17XJ6, B2UTG4, Q8Y691, A0AJR0, B8DDU8, Q71YL2, C1KWA4, Q92AK3 | |
| 1388 | NEWDPLEEV | Streptomyces griseus | P29780 | P50440 |
| 1389 | NEWDPLEEVIVG | Streptomyces griseus | P08078 | P50440 |
| 1390 | NFCANNYLGL | Escherichia coli, Escherichia coli | P0AB77, P0AB78 | O75600 |
| 1391 | NFGPQHPAAHGVLR | Neisseria gonorrhoeae, Neisseria gonorrhoeae, Neisseria meningitidis, Neisseria meningitidis, Neisseria meningitidis, Sphingomonas wittichii | B4RPI1, Q5F618, Q9K1C0, A1KRS5, A1INN7, A9M3D9, A5VAM0 | O75306 |
| 1392 | NFGPQHPAAHGVLRL | Stenotrophomonas maltophilia, Stenotrophomonas maltophilia | B4SQT3, B2FNX6 | O75306 |
| 1393 | NFGPQHPAAHGVLRLV | Methylobacterium sp., Methylobacterium populi, Methylobacterium extorquens, Methylobacterium radiotolerans, Rhizobium etli, Rhizobium leguminosarum, Rhizobium etli, Rhizobium leguminosarum, Rhizobium loti, Rhizobium meliloti | B0ULK7, B1ZA43, A9W1N0, B1LUN4, Q2K9T1, B5ZYL5, B3PW00, Q1MIL2, Q98KQ8, P56907 | O75306 |
| 1394 | NGAFTGEISP | Bacillus clausii, Bacillus cytotoxicus, Bacillus pumilus, Bacillus methylotrophicus, Bacillus weihenstephanensis, Bacillus cereus, Bacillus cereus, Bacillus cereus, Bacillus anthracis, Bacillus thuringiensis, Bacillus cereus, Bacillus cereus, Bacillus cereus, Bacillus cereus, Bacillus cereus | Q5WDK7, A7GUR9, A8FHJ2, A7Z8Y3, A9VQ50, Q72XY3, B7JFG5, B7HW54, Q81X76, Q6HBF1, Q631M0, Q4MQ55, P60180, B7HED4, B7IP22 | P60174 |
| 1395 | NGAGKSTLL | Geobacter sulfurreducens | Q74DN5 | Q8WWZ4 |
| 1396 | NGAGKSTTI | Bacillus subtilis | P55339 | Q8IUA7 |
| 1397 | NGAGKTTTF | Bacillus subtilis, Bacillus pseudofirmus | C0SPB4, P26946 | Q99758 |
| 1398 | NGAGKTTTI | Bacillus licheniformis | P42332 | Q86UK0 |
| 1399 | NGIVHRDIKP | Clostridium acetobutylicum | Q97IC2 | Q14164 |
| 1400 | NGKDYYFVTRE | Lactobacillus delbrueckii | Q1G9H8 | Q16774 |
| 1401 | NGKVALVTGAA | Pseudomonas aeruginosa | Q51576 | P15428 |
| 1402 | NGLANPRDFL | Pseudomonas aeruginosa, Pseudomonas aeruginosa, Pseudomonas aeruginosa, Pseudomonas aeruginosa, Pseudomonas fluorescens, Pseudomonas entomophila, Pseudomonas putida, Pseudomonas putida, Pseudomonas putida, Pseudomonas putida, Pseudomonas fluorescens, Pseudomonas savastanoi, Pseudomonas syringae, Ralstonia pickettii, Ralstonia solanacearum | Q9X4G0, B7VA96, Q02LF6, A6V6F5, Q4KI35, Q1I500, B0KGU6, Q88E47, Q6EMI9, A5W8Z1, B1J390, Q3KHV3, Q48GS7, Q87Z79, B2UJ73, Q8XRZ0 | Q93099 |
| 1403 | NGMDVFRVFD | Klebsiella pneumoniae | P13187 | P11498 |
| 1404 | NGNEIGGGSIRIH | Corynebacterium urealyticum, Corynebacterium aurimucosum, Corynebacterium jeikeium, | B1VDL1, C3PGN5, Q4JVF2, Q8NQ19, A4QEL0, Q8FT19, | Q6PI48 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Corynebacterium glutamicum, Corynebacterium glutamicum, Corynebacterium efficiens, Micrococcus luteus* | C5CCH2 | |
| 1405 | NHPDLRRIL | *Geobacter metallireducens, Geobacter sulfurreducens* | Q39QA9, Q74GA6 | O75489 |
| 1406 | NHPDLRRILTDYGF | *Neisseria meningitidis, Neisseria meningitidis, Neisseria meningitidis, Neisseria gonorrhoeae, Neisseria gonorrhoeae* | Q9K1C1, Q9JX80, A1KRS4, A9M3E0, B4RPI2, Q5F617 | O75489 |
| 1407 | NIGIGGSDLG | *Campylobacter jejuni, Helicobacter acinonychis, Helicobacter pylori, Helicobacter pylori, Helicobacter pylori, Helicobacter pylori, Helicobacter pylori* | A7H491, Q17W92, B2UUS4, Q9ZK49, Q25781, B6JNO6, Q1CSA0, B5Z8G1 | P06744 |
| 1408 | NIGIGGSDLGP | *Bifidobacterium longum, Corynebacterium diphtheriae, Corynebacterium glutamicum, Corynebacterium glutamicum, Corynebacterium efficiens, Corynebacterium kropnstedtii, Corynebacterium jeikeium, Ralstonia solanacearum, Rhizobium loti, Streptomyces griseus, Streptomyces coelicolor, Streptomyces avermitilis, Streptomyces coelicolor,* Uncultured termite | Q8G7I6, Q6NIE5, A4QCJ4, Q8NS31, Q8FR39, C4LHE0, Q4JX51, Q8XYN9, Q98BV5, B1W0Z7, Q9Z523, Q82M90, O88015, B1H069 | P06744 |
| 1409 | NIIDTPGHVDFT | *Bacillus pumilus, Bacillus licheniformis, Bacillus methylotrophicus, Bacillus subtilis, Bacillus weihenstephanensis, Bacillus cereus, Bacillus cereus, Bacillus cytotoxicus, Bacillus anthracis, Bacillus cereus, Bacillus thuringiensis, Bacillus cereus, Bacillus anthracis, Bacillus anthracis, Bacillus cereus, Bacillus cereus, Bacillus cereus, Bacillus cereus, Bacillus cereus, Bacillus cereus, Clostridium botulinum, Clostridium botulinum, Clostridium botulinum, Clostridium botulinum, Clostridium botulinum, Clostridium botulinum, Clostridium botulinum, Clostridium botulinum, Clostridium beijerinckii, Clostridium perfringens, Clostridium perfringens, Clostridium perfringens, Corynebacterium glutamicum, Corynebacterium glutamicum, Corynebacterium diphtheriae, Listeria innocua, Listeria welshimeri, Listeria monocytogenes, Listeria monocytogenes, Listeria monocytogenes, Listeria monocytogenes,* Uncultured termite | A8F981, Q65PB0, A7Z0N4, P80868, A9VP74, Q814C5, B7HJ45, A7GK17, C3LJ79, Q63H93, Q6HPR1, C1ET36, Q81VT3, C3P9Q2, B9IZJ1, B7HQU1, Q73F99, B7IT16, B7JKB6, B1IGF7, A7GJ77, A5I7K9, A7FZ72, C3KVQ4, B1KSM8, C1FMV4, A6LPQ8, Q0SQE1, Q8XHS1, Q0TMP3, Q8NT19, A4QBG9, Q6NJD6, Q92715, A0ALY9, Q8Y421, B8DAY6, C1KZK7, Q71WB8, B1GZ80 | Q96RP9 |
| 1410 | NIIDTPGHVDFTIEV | *Streptococcus suis, Streptococcus suis, Streptococcus agalactiae, Streptococcus thermophilus, Streptococcus thermophilus, Streptococcus thermophilus, Streptococcus agalactiae, Streptococcus agalactiae, Streptococcus sanguinis, Streptococcus gordonii, Streptococcus pneumoniae, Streptococcus mutans, Streptococcus pneumoniae, Streptococcus pneumoniae, Streptococcus pneumoniae, Streptococcus pneumoniae, Streptococcus pneumoniae, Streptococcus pneumoniae, Streptococcus* | A4VSN3, A4VYX6, Q8E3E7, Q03IS1, Q5M2M6, Q5LY21, Q8DXS7, Q3JZB5, A3CQM2, A8AUR6, C1CIF3, Q8DW4, C1CPE5, B2ISJ9, B8ZKU0, C1CC62, P64023, P64022, B1I8Z9, C1CB46, B5E6U5, Q04MH7 | Q96RP9 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | pneumoniae, Streptococcus pneumoniae, Streptococcus pneumoniae | | |
| 1411 | NIIDTPGHVDFTIEVER | Lactobacillus sakei, Lactobacillus casei, Lactobacillus casei, Methylobacterium nodulans, Methylobacterium populi, Geobacter sulfurreducens, Pseudomonas aeruginosa, Pseudomonas putida, Rhizobium leguminosarum, Rhizobium leguminosarum, Rhizobium etli, Rhizobium etli, Rhizobium sp., Rhizobium meliloti | Q38UQ9, B3WAM2, Q034X8, B8IS82, B1ZLK1, Q748Y8, Q9I244, Q88FI4, Q1MIE4, B5ZYT2, B3PWR8, Q2K9L9, C3MAX7, Q920H2 | Q96RP9 |
| 1412 | NIRNFSIVAH | Methylobacterium extorquens, Methylobacterium populi | B7KR78, B1ZC10 | Q8N442 |
| 1413 | NKEIFLREL | Helicobacter pylori, Ralstonia solanacearum | P56116, Q8Y0Q3 | P14625 |
| 1414 | NKEIFLRELISNA | Fusobacterium nucleatum | Q8RGH4 | P14625 |
| 1415 | NKEIFLRELISNASDA | Aggregatibacter actinomycetemcomitans, Citrobacter koseri, Clostridium tetani, Clostridium acetobutylicum, Enterobacter sp., Escherichia coli, Escherichia coli, Escherichia coli, Escherichia coli, Escherichia coli, Escherichia coli, Escherichia coli, Escherichia coli, Escherichia coli, Haemophilus parasuis, Haemophilus influenzae, Haemophilus influenzae, Haemophilus influenzae, Haemophilus somnus, Haemophilus influenzae, Klebsiella pneumoniae, Pseudomonas aeruginosa, Pseudomonas mendocina, Pseudomonas aeruginosa, Pseudomonas savastanoi, Pseudomonas syringae, Pseudomonas putida, Pseudomonas fluorescens, Pseudomonas syringae, Pseudomonas fluorescens, Pseudomonas fluorescens | P54649, A8AJX0, Q894P6, Q97E05, A4W7F7, P0A6Z3, P0A6Z4, B1IZC1, Q0TKG8, A7ZXD1, P0A6Z5, Q1RF62, A1A8D9, A7ZIN3, B8F5X3, A5UFQ9, Q4QP81, A5UB42, Q0I2A3, P44516, A6T5N6, Q9I3C5, A4XV81, A6V7J7, Q48K64, Q4ZUW2, Q88FB9, Q4KFX8, Q883Y9, Q3KFT8, C3K6N7 | P14625 |
| 1416 | NKEIFLRELISNASDALDK | Campylobacter hominis, Campylobacter jejuni, Campylobacter jejuni, Campylobacter jejuni, Campylobacter jejuni, Campylobacter jejuni | A7I226, A1VYN0, Q9PHZ3, A8FKU4, A7H4M0, Q5HVP5 | P14625 |
| 1417 | NKEPGAEEK | Streptococcus thermophilus, Streptococcus thermophilus, Streptococcus mutans | Q5M6D0, Q5M1T7, Q8DWH2 | P25685 |
| 1418 | NKYSEGYPG | Lactobacillus plantarum | Q88UT5 | P34896 |
| 1419 | NLDEFAMGS | Lactobacillus fermentum, Methylobacterium populi, Methylobacterium extorquens, Methylobacterium extorquens | B2GDS6, B1ZLM1, A9W748, B7KWB0 | Q9H0R6 |
| 1420 | NLFAIIQGG | Helicobacter acinonychis | Q17YB5 | Q9BXR0 |
| 1421 | NLGFSPEDR | Staphylococcus carnosus, Staphylococcus saprophyticus | B9DLK2, Q49UM5 | O43252 |
| 1422 | NLIGEHTDYN | Lactobacillus plantarum, Lactobacillus salivarius, Lactobacillus casei, Lactobacillus casei, Lactobacillus casei, Enterococcus faecalis, Staphylococcus saprophyticus, Staphylococcus carnosus, Streptococcus pneumoniae, Streptococcus pneumoniae, Streptococcus thermophilus, Streptococcus thermophilus, Streptococcus thermophilus, Streptococcus mutans, Streptococcus suis, Streptomyces lividans | Q885E8, Q1WUZ4, O84902, B3W7I5, Q03BB8, Q836P0, Q49ZK2, Q9RGS1, Q8DNK7, Q97NZ6, Q9ZB10, Q5LYY7, Q03JS8, P96993, A4VT88, P13227 | P51570 |
| 1423 | NLMELLIMI | Clostridium perfringens, Listeria innocua, Listeria monocytogenes, | Q8XHJ4, Q92F68, Q48793, Q724L4, | P11908 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Listeria monocytogenes, Listeria welshimeri, Listeria ivanovii | Q83TK1, Q83YI7 | |
| 1424 | NLSGGQKQR | Lactobacillus delbrueckii | Q04BY7 | Q92887 |
| 1425 | NLSPNGGGEP | Corynebacterium diphtheriae | P42821 | P04179 |
| 1426 | NMILDDGGD | Methylobacterium sp., Methylobacterium nodulans, Methylobacterium populi, Methylobacterium extorquens, Methylobacterium extorquens | B0UM37, B8IPU4, B1ZLX0, A9VYP7, B7KSJ4 | P23526 |
| 1427 | NPAFDVTPH | Bacillus pumilus | A8FCG5 | Q9BV20 |
| 1428 | NPETVSTDF | Bacillus cytotoxicus, Bacillus cereus, Bacillus cereus, Bacillus cereus, Bacillus cereus, Bacillus cereus, Bacillus cereus, Bacillus thuringiensis, Bacillus anthracis, Bacillus anthracis, Bacillus anthracis, Bacillus cereus, Bacillus thuringiensis, Bacillus weihenstephanensis, Bacillus cereus, Bacillus cereus, Bacillus cereus, Bacillus halodurans, Lactobacillus sakei, Lactobacillus salivarius, Lactobacillus plantarum, Lactobacillus plantarum, Propionibacterium acnes, Enterococcus faecalis, Leuconostoc mesenteroides, Leuconostoc citreum, Listeria innocua, Listeria monocytogenes, Listeria welshimeri, Listeria monocytogenes, Listeria monocytogenes, Listeria monocytogenes, Pediococcus ntosaceus, Streptococcus thermophilus, Streptococcus thermophilus, Streptococcus thermophilus, Streptococcus agalactiae, Streptococcus agalactiae, Streptococcus agalactiae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus mutans, Streptococcus sanguinis, Streptococcus equi, Streptococcus gordonii, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus equi | A7GRL1, B7JJX3, Q732I3, B7IUP6, B9IVW3, B7HLM0, Q6HE58, C3P656, Q81WF2, C3L740, C1EPQ0, A0RHQ8, A9VTC6, Q636E0, Q819S3, B7H6M2, Q9K9V9, Q38X24, Q1WVA9, P77886, Q9RLS9, Q6A914, Q834E2, Q03WW7, B1MZ74, Q92AH3, Q71YI1, A0AJU0, Q8Y665, B8DDR7, C1KWD4, Q03HB0, Q5M0W9, Q5M5F6, Q03LT8, Q3K150, Q8E5F5, Q8DZQ7, C10EM9, B1I065, B5E512, C1C7Q3, B8ZJT9, B2IQ67, Q8CVVR0, Q970E4, C1CR31, Q04K48, C1CL09, Q8DUP3, A3CNI5, C0MEH1, A8AX83, A2RF60, B5XKW2, Q9A006, Q5XCR6, P0DA15, P0DA14, P58941, C0M756 | P31327 |
| 1429 | NPETVSTDFD | Clostridium acetobutylicum, Clostridium beijerinckii | Q97FT3, A6LPD9 | P31327 |
| 1430 | NPFDLTKVWPH | Proteus mirabilis | P42321 | P04040 |
| 1431 | NPGDGAFYGPK | Fusobacterium nucleatum | Q8RF56 | A2RTX5 |
| 1432 | NPTYKEVCS | Listeria welshimeri, Listeria monocytogenes, Listeria monocytogenes, Listeria monocytogenes, Listeria innocua, Streptococcus agalactiae, Streptococcus agalactiae, Streptococcus agalactiae | A0AJW5, Q8Y640, B8DDP2, Q71YF6, C1KWF9, Q92AE8, Q8DYH1, Q3K013, Q8E434 | Q9UJ68 |
| 1433 | NPVDILTYV | Bacillus cereus, Bacillus thuringiensis, Bacillus anthracis, Bacillus cereus, | Q632G8, Q6HC14, Q81K80, Q816G3, | Q9BYZ2 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Bacillus cereus, Bacillus thuringiensis, Bacillus cereus, Bacillus cereus, Bacillus anthracis, Bacillus cereus, Clostridium thermocellum | P62048, Q6HK31, Q63CN1, P62047, Q81RW4, Q81EP4, Q8KQC4 | |
| 1434 | NPVPVMKLVEVI | Bacillus subtilis | P45856 | Q16836 |
| 1435 | NQIVHRDIK | Bacillus subtilis | O34507 | Q99683 |
| 1436 | NQRETTVIWDK | Lactobacillus sakei, Pediococcus ntosaceus, Staphylococcus haemolyticus, Streptococcus pyogenes, Streptococcus pyogenes, Streptococcus uberis | Q38XX6, Q03DS8, Q4L607, P0DA17, P0DA16, B9DV90 | Q14410 |
| 1437 | NQRETTVVW | Aeromonas hydrophila, Aeromonas salmonicida, Clostridium botulinum, Clostridium botulinum, Clostridium botulinum, Clostridium botulinum, Clostridium botulinum, Geobacter sp., Geobacter bemidjiensis, Ralstonia solanacearum | A0KIT3, A4SPA7, C1FUW6, A7GH02, B1IKJ7, C3L254, B1KYK0, A5I5M0, A7FX30, C6E1L8, B5EB79, Q8XUY1 | Q14409 |
| 1438 | NQRETTVVWD | Desulfovibrio alaskensis, Geobacter sulfurreducens, Geobacter lovleyi, Pseudomonas aeruginosa, Stenotrophomonas maltophilia, Stenotrophomonas maltophilia, Streptomyces coelicolor, Streptomyces avermitilis | Q316D5, Q749I1, B3E6Z6, Q51390, B4SJT3, B2FI02, Q9RJM2, Q826J2 | O14409 |
| 1439 | NQRETTVVWDK | Acinetobacter baylyi, Bacillus cereus, Bacillus cereus, Bacillus cereus, Bacillus methylotrophicus, Bacillus subtilis, Bacillus licheniformis, Lactobacillus plantarum, Lactobacillus delbrueckii, Desulfitobacterium hafniense, Corynebacterium kropnstedtii, Corynebacterium glutamicum, Corynebacterium glutamicum, Desulfovibrio salexigens, Desulfovibrio vulgaris, Desulfovibrio maeticus, Desulfovibrio vulgaris, Desulfovibrio vulgaris, Enterococcus casseliflavus, Enterococcus faecalis, Pseudomonas putida, Pseudomonas fluorescens, Pseudomonas putida, Pseudomonas fluorescens, Pseudomonas entomophila, Pseudomonas putida, Pseudomonas fluorescens, Pseudomonas tolaasii, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus saprophyticus, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, | Q6FDN3, B7IKB1, Q81GZ2, B7HG04, A7Z2U3, P18157, Q65M11, Q88YD9, Q047N5, B8FXS7, C4LGQ3, Q8NLP9, A4QHT1, C6C1M7, B8DL62, C4XGV9, A1VA10, Q726H4, O34153, O34154, Q88NX8, Q3K7I5, A5VZG7, Q4K734, Q1IE16, B0KUG0, C3KBM0, O87924, A8Z1X0, A6QGJ8, Q5HGD2, Q2FYZ5, Q2FHD9, P99113, P63741, A5IS12, A6U1B8, A7X1U3, Q6GHD5, Q2YXR6, Q8NWX7, Q6G9R3, Q5HPP1, Q8CSS0, Q49X93, Q8NZW9, Q1J5E4, B5XMM6, A2RD27, Q1JFJ5, Q1JKK3, Q1JAF2, Q99YI7, Q48RX6, Q5XAJ9, B5E357, Q8E1T0, Q3K3A6, Q8E794, C1CNF8, B1I9Z6, B8ZQ22, C1CUA3, C1CHI6, P63743, B2INK5, P63742, Q04HZ0, C1CBG2, A3CPV3, A8AVX5 | Q14409 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus pyogenes,* *Streptococcus pneumoniae,* *Streptococcus agalactiae,* *Streptococcus agalactiae,* *Streptococcus agalactiae,* *Streptococcus pneumoniae,* *Streptococcus pneumoniae,* *Streptococcus pneumoniae,* *Streptococcus pneumoniae,* *Streptococcus pneumoniae,* *Streptococcus pneumoniae,* *Streptococcus pneumoniae,* *Streptococcus pneumoniae,* *Streptococcus pneumoniae,* *Streptococcus pneumoniae,* *Streptococcus sanguinis,* *Streptococcus gordonii* | | |
| 1440 | NRDHRKIGK | *Acinetobacter baumannii* | B0VKJ4 | A2RTX5 |
| 1441 | NRKVLADLA | *Parabacteroides distasonis, Bacteroides fragilis, Bacteroides fragilis, Porphyromonas gingivalis* | A6L955, Q5LEQ3, Q64VN9, Q7MVQ8 | Q9BYC9 |
| 1442 | NRLGANSLL | *Bacillus subtilis* | P08065 | P31040 |
| 1443 | NRPKALNAL | *Clostridium acetobutylicum* | P52046 | P30084 |
| 1444 | NRSASIRIP | *Escherichia coli, Escherichia coli, Escherichia coli, Haemophilus influenzae, Neisseria gonorrhoeae, Proteus hauseri, Pseudomonas aeruginosa, Pseudomonas taetrolens* | P0A9C6, P0A9C7, P0A9C5, P43794, P25821, P28786, Q9HU65, Q3V5W6 | P15104 |
| 1445 | NSAVFPGLQGGP | *Ralstonia solanacearum, Rhizobium meliloti, Rhizobium leguminosarum, Rhizobium loti, Rhizobium etli, Rhizobium meliloti, Sphingomonas wittichii, Streptococcus thermophilus* | Q8XTQ1, Q9Q0U6, Q1MIU5, Q983B6, Q2KA25, Q92XS8, A5V5D1, Q5M4W1 | P34896 |
| 1446 | NSFGFGGTNATL | *Escherichia coli, Escherichia coli, Haemophilus influenzae, Pseudomonas aeruginosa* | P0A954, P0A953, P43710, Q02K94 | Q9NWU1 |
| 1447 | NTARGGLVDE | *Methylobacterium extorquens* | Q59516 | Q13363 |
| 1448 | NTDAEGRLIL | *Desulfovibrio alaskensis, Neisseria meningitidis, Ralstonia pickettii, Ralstonia solanacearum, Stenotrophomonas maltophilia, Stenotrophomonas maltophilia* | Q315M7, Q9JTI8, B2UAK8, Q8XWQ8, B2FMS4, B4SJ73 | P28838 |
| 1449 | NTDAEGRLILADA | *Corynebacterium glutamicum, Corynebacterium efficiens* | Q8NNJ4, Q8FNP8 | P28838 |
| 1450 | NTDAEGRLVL | *Acinetobacter baumannii, Acinetobacter baumannii, Acinetobacter baumannii, Acinetobacter baumannii, Acinetobacter baumannii, Acinetobacter baumannii, Acinetobacter baylyi, Edwardsiella ictaluri, Haemophilus ducreyi, Haemophilus parasuis, Haemophilus influenzae, Haemophilus influenzae, Haemophilus influenzae, Haemophilus somnus, Haemophilus influenzae, Helicobacter hepaticus, Pseudomonas fluorescens, Pseudomonas putida, Pseudomonas putida, Pseudomonas fluorescens, Pseudomonas putida, Pseudomonas putida, Pseudomonas entomophila, Pseudomonas syringae, Pseudomonas aeruginosa, Pseudomonas aeruginosa, Pseudomonas aeruginosa, Pseudomonas aeruginosa, Pseudomonas syringae, Pseudomonas stutzeri, Rhizobium leguminosarum, Rhizobium leguminosarum, Rhizobium etli,* | B0VMG3, B2I1U0, A3M1A8, B0VDC8, B71309, B7H1P9, Q6FFD8, C5BBY4, Q7VNH9, B8F6N9, A5UBH1, Q4QJN7, P45334, Q0I236, A5UFE2, Q7VGF0, C3K6G5, B1JBA9, Q88P73, Q3KHM4, B0KQK8, A5VZ69, Q86436, Q1I5F9, Q4ZXH7, B7UVT6, O68822, A6V0T2, Q02RY8, Q887M0, A4VNZ7, Q1MIZ4, B5ZWY7, Q2KA77, B3PUV3, Q92QY7, C3M9C8, B9DIX2 | Q8NDH3 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Rhizobium etli, Rhizobium meliloti, Rhizobium* sp., *Staphylococcus carnosus* | | |
| 1451 | NTDAEGRLVLAD | *Campylobacter jejuni, Corynebacterium diphtheriae, Helicobacter acinonychis, Helicobacter pylori, Helicobacter pylori, Helicobacter pylori, Helicobacter pylori, Helicobacter pylori, Rhizobium loti, Streptomyces avermitilis, Streptomyces griseus, Streptomyces coelicolor* | Q9PP04, Q6NG90, Q17W06, B5Z6U1, O25294, B6JLF2, Q9ZLR1, Q1CTV6, B2UTQ8, Q984S1, Q82AN2, B1VZN5, Q9S2Q7 | Q8NDH3 |
| 1452 | NTDAEGRLVLADG | *Bacillus methylotrophicus, Bacillus subtilis, Enterobacter* sp. | A7Z8B5, O32106, A4WDA4 | Q8NDH3 |
| 1453 | NTDAEGRLVLADGV | *Bacillus pumilus* | A8FH04 | Q8NDH3 |
| 1454 | NTDNMSILGLTIDYGP | *Enterobacter* sp., *Klebsiella pneumoniae, Klebsiella pneumoniae* | A4W9N5, A6TAH1, B5XQE2 | Q9BVL4 |
| 1455 | NTFVAELKG | *Citrobacter koseri, Enterobacter* sp., *Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Klebsiella pneumoniae, Klebsiella pneumoniae, Klebsiella variicola, Klebsiella oxytoca, Raoultella terrigena* | A8AQC8, A4WF48, Q1R6A3, P61889, P61890, B1XHK9, A1AGC9, A8A545, C4ZSX4, B7N0M1, B5YSW2, P61891, B7MBZ7, A7ZSD0, B7UJW8, B7M0U8, B7LHU4, Q0TCN0, B1IQP3, B1LGK2, B7NKU9, B6I1V4, B7LRL0, B7NDL4, A6TEQ3, B5XSQ7, P61896, P61894, P61895 | P40926 |
| 1456 | NVGKSSIIN | *Clostridium cellulolyticum* | B8I8N7 | Q9BVP2 |
| 1457 | NVGKSSIINSL | *Clostridium perfringens, Clostridium perfringens, Clostridium perfringens* | Q8XKK5, Q0TQK6, Q0ST57 | Q9BVP2 |
| 1458 | NVGKSSLIN | *Lactobacillus casei, Lactobacillus casei, Lactobacillus acidophilus, Lactobacillus gasseri, Lactobacillus helveticus, Lactobacillus sakei, Fusobacterium nucleatum, Bacteroides fragilis, Bacteroides fragilis, Bacteroides vulgatus, Bacteroides thetaiotaomicron, Clostridium kluyveri, Clostridium acetobutylicum, Eubacterium eligens, Geobacter sulfurreducens, Geobacter daltonii, Geobacter metallireducens, Geobacter uraniireducens, Geobacter lovleyi, Rhizobium meliloti* | B3WE42, Q039K2, Q5FKR5, Q042T8, A8YUS5, Q38WS0, Q8RHK1, Q5LDL2, Q64UN4, A6L4J3, Q8A8T4, A5N2K5, Q97FU0, C4Z1T3, Q748I9, B9LZU0, Q39YG6, A5G964, B3E2D1, Q92SF6 | Q9NVN8 |
| 1459 | NVGKSSLINGL | *Clostridium phytofermentans* | A9KHA0 | P36915 |
| 1460 | NVGKSSLINSL | *Clostridium botulinum, Clostridium beijerinckii, Clostridium botulinum* | B2TPB6, A6LT31, B2UX10 | Q9NVN8 |
| 1461 | NVGTIGHVDHG | *Pseudomonas syringae* | Q889X3 | P49411 |
| 1462 | PAKSGVAGG | *Corynebacterium glutamicum* | Q8NMT3 | O94925 |
| 1463 | PAKSGVAGGI | *Bacillus cytotoxicus, Bacillus weihenstephanensis, Bacillus cereus, Bacillus cereus, Bacillus cereus, Bacillus anthracis* | A7GKX3, A9VSP6, Q81I63, C1EWD5, Q73E07, Q81YY0 | O94925 |
| 1464 | PCGACRQVM | *Bacillus halodurans* | Q9KD53 | P32320 |
| 1465 | PCGTTIGPI | *Streptomyces coelicolor, Streptomyces avermitilis* | Q9XA76, Q82F74 | Q9ULA0 |
| 1466 | PDGGIARLRV | *Streptomyces coelicolor, Streptomyces avermitilis* | Q9RKU4, Q82LL5 | Q8N6M5 |
| 1467 | PDGGVSRLR | *Pseudomonas syringae, Pseudomonas fluorescens, Pseudomonas savastanoi, Pseudomonas syringae, Pseudomonas fluorescens* | Q4ZVG8, C3K0A7, Q48KS4, Q87YX4, Q3KFK9 | Q8N6M5 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1468 | PDGGVSRLRL | *Pseudomonas fluorescens, Pseudomonas stutzeri* | Q4K8H3, A4VP32 | Q8N6M5 |
| 1469 | PDIVTMAKG | *Bilophila wadsworthia* | Q9APM5 | Q9BYV1 |
| 1470 | PDKDVDGFH | *Citrobacter koseri, Edwardsiella ictaluri, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis, Pseudomonas fluorescens, Pseudomonas aeruginosa, Pseudomonas aeruginosa, Pseudomonas aeruginosa, Pseudomonas fluorescens, Pseudomonas syringae, Pseudomonas putida, Pseudomonas entomophila, Pseudomonas putida, Pseudomonas putida, Pseudomonas savastanoi, Pseudomonas aeruginosa, Pseudomonas putida, Pseudomonas syringae, Pseudomonas syringae, Pseudomonas stutzeri, Staphylococcus aureus, Staphylococcus aureus* | A8AJS4, C5B8V3, A4W7J0, B7LJI7, C4ZUX7, P24186, B1IZ72, B1XGC7, B7M4N2, B7L7F6, B6I0H4, A7ZIT8, B7N983, B1LKE8, B7NL23, B7MRJ2, Q1RF04, Q8FK41, Q0TKB2, Q8XCT6, B5YPP4, A1A8J4, A7ZXI3, B7ME52, B7UKK6, A6T5R4, B5Y0K4, B4F1G5, Q3K9W7, Q02KT7, Q9I2U6, B7VB83, Q4K9J4, Q4ZUA4, B1J675, Q1ICB3, A5W638, Q88KM5, Q48KZ8, A6V726, B0KJG3, Q4ZVN1, Q87YR0, A4VL74, Q2YX11, Q6GI21 | P13995 |
| 1471 | PDNYKVIFLQGG | *Streptococcus agalactiae* | Q8E3Y3 | Q9Y617 |
| 1472 | PEEKRKIIG | *Campylobacter hominis, Pseudomonas aeruginosa, Pseudomonas aeruginosa, Pseudomonas aeruginosa, Streptomyces avermitilis* | A7I131, Q02R52, Q9HXM6, B7UXJ9, Q82HM9 | P49915 |
| 1473 | PEGATPKDGPSAG | *Fusobacterium nucleatum* | Q8RHK0 | P36776 |
| 1474 | PEGLAVSLP | *Campylobacter jejuni* | Q9PIN2 | Q8N155 |
| 1475 | PEKDVDGFH | *Lactobacillus fermentum* | B2GD67 | Q9H903 |
| 1476 | PERWHAKGAGA | *Bacillus subtilis* | P26901 | P04040 |
| 1477 | PFDLTKVWP | *Neisseria gonorrhoeae* | Q59602 | P04040 |
| 1478 | PFGGFKMSG | *Bacillus licheniformis, Bacillus halodurans, Bacillus subtilis, Bacillus halodurans, Bacillus pumilus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Staphylococcus aureus, Staphylococcus epidermidis, Staphylococcus epidermidis* | Q65NN2, Q9K9B2, P94391, Q9K5Z5, A8F9T1, A8Z3F5, A5IVY0, A6QK44, Q6GDP4, P99076, A6U4T5, P63939, Q5HCZ6, Q2YWA6, Q2FV67, Q2FDV3, A7X6R7, Q8NUR2, Q4A0E7, Q6G6C0, Q8CN04, Q5HL59 | O94788 |
| 1479 | PFGGVGASG | *Acinetobacter baylyi, Citrobacter koseri, Enterobacter sp., Escherichia fergusonii, Pseudomonas entomophila, Pseudomonas fluorescens, Pseudomonas savastanoi, Pseudomonas* | Q6FCQ0, A8AHD8, A4W9J7, B7L046, Q1I6Z5, Q4K837, Q48G19, C3JXY7, Q885J7, A5W0D5, Q88EI4, B0KR47, | P43353 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | fluorescens, Pseudomonas syringae, Pseudomonas putida, Pseudomonas putida, Pseudomonas putida, Pseudomonas syringae, Pseudomonas fluorescens | Q4ZQH8, Q3K885 | |
| 1480 | PFGGYKKSG | Staphylococcus haemolyticus | Q4L919 | P49189 |
| 1481 | PFNFPAMIPLWMFP | Pseudomonas aeruginosa | P28810 | Q02252 |
| 1482 | PFNIASYALL | Porphyromonas gingivalis | Q7MTB5 | P04818 |
| 1483 | PFPGPGLAIR | Propionibacterium acnes | Q6A6X1 | P49915 |
| 1484 | PFPGPGLAIRV | Lactobacillus gasseri, Clostridium kluyveri, Clostridium kluyveri, Clostridium perfringens, Clostridium beijerinckii, Clostridium novyi, Clostridium botulinum, Clostridium botulinum, Clostridium botulinum, Clostridium botulinum, Clostridium botulinum, Clostridium botulinum, Clostridium botulinum, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae | Q04612, B9DYY7, A5N5D9, Q8XI46, A6L090, A0Q2S8, C3KUC5, A5I720, A7FYP0, A7GIN0, B1IFD1, B1L1J7, C1FLV2, C1CF29, B8ZKZ5, B1ICM9, P64298, C1CQS0, C1C842, P64297, B5E5U0, Q04JQ8, C1CLE8, B2IQR1 | P49915 |
| 1485 | PFPGPGLAIRVI | Lactobacillus delbrueckii, Lactobacillus delbrueckii | Q1GBU7, Q04CA4 | P49915 |
| 1486 | PFRLGLGGPIGSG | Escherichia coli | P77775 | Q9NRG7 |
| 1487 | PFSMGPLGS | Acinetobacter baylyi, Acinetobacter baumannii, Acinetobacter baumannii, Acinetobacter baumannii, Acinetobacter baumannii, Acinetobacter baumannii, Acinetobacter baumannii | Q6F8P2, B0VSN6, B2HXC1, A3M840, B7GY31, B0VDR1, B7I624 | P35558 |
| 1488 | PFSMGPLGSP | Ralstonia solanacearum, Ralstonia pickettii | Q8Y3G3, B2U804 | P35558 |
| 1489 | PGAGGTQRL | Escherichia coli | P76082 | P30084 |
| 1490 | PGAGKGTQA | Aeromonas hydrophila, Aeromonas salmonicida, Bacillus halodurans, Bacillus clausii, Bacillus cytotoxicus, Bacillus cereus, Bacillus cereus, Bacillus cereus, Bacillus cereus, Bacillus cereus, Bacillus weihenstephanensis, Bacillus cereus, Bacillus anthracis, Bacillus thuringiensis, Bacillus cereus, Bacillus anthracis, Bacillus thuringiensis, Bacillus cereus, Bacillus cereus, Bacillus anthracis, Bacillus licheniformis, Bacillus pumilus, Lactobacillus casei, Lactobacillus reuteri, Lactobacillus fermentum, Eubacterium rectale, Fusobacterium nucleatum, Eubacterium eligens, Propionibacterium acnes, Citrobacter koseri, Clostridium thermocellum, Clostridium phytofermentans, Clostridium cellulolyticum, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, | A0KL52, A4SLY1, P38372, Q5WLP1, A7GK41, B7HJ69, Q81J22, B7HQW5, B9IZL5, Q73F75, A9VP98, B7IT40, Q81VQ9, Q6HPN7, B7JKE1, C3P9S6, A0R8K1, Q63H69, C1ET60, C3LJA3, P35140, A8F9A6, B3WAJ7, B2G8V7, B2GDU8, C4ZBT9, Q8RE31, C4Z2V1, Q6A6Q4, A8AJW9, A3DJJ3, A9KJH3, B8I800, C5BD16, A4W7F8, Q8FK84, B7NIF6, Q0TKG7, B7UKF4, B7MQI9, B1IZC0, B6I0Q6, A7ZIN4, P69441, B7LV13, P69442, B1LJN2, A7ZXD2, B1XFR1, B7N927, B7L799, C4ZUS8, B7M3W6, B7MDZ6, Q4QNJ1, A5UAD6, P24323, A5UGF8, Q7VMY0, Q0I2Y5, | P54819 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Escherichia coli, Escherichia coli, Escherichia coli, Escherichia coli, Haemophilus influenzae, Haemophilus influenzae, Haemophilus influenzae, Haemophilus influenzae, Haemophilus ducreyi, Haemophilus somnus, Klebsiella pneumoniae, Klebsiella pneumoniae, Listeria innocua, Listeria monocytogenes, Listeria monocytogenes, Listeria welshimeri, Listeria monocytogenes, Listeria monocytogenes, Neisseria meningitidis, Neisseria meningitidis, Neisseria meningitidis, Neisseria meningitidis, Neisseria meningitidis, Neisseria meningitidis, Neisseria gonorrhoeae, Neisseria gonorrhoeae, Neisseria gonorrhoeae, Neisseria mucosa, Proteus mirabilis, Pseudomonas mendocina, Pseudomonas putida, Pseudomonas putida, Pseudomonas fluorescens, Pseudomonas aeruginosa, Pseudomonas aeruginosa, Pseudomonas aeruginosa, Pseudomonas aeruginosa, Pseudomonas fluorescens, Pseudomonas putida, Pseudomonas putida, Pseudomonas putida, Pseudomonas syringae, Pseudomonas fluorescens, Pseudomonas entomophila, Pseudomonas savastanoi, Pseudomonas syringae, Ralstonia pickettii, Ralstonia solanacearum, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Streptococcus suis, Streptococcus suis* | A6T5N7, B5Y0N3, Q927M8, C1KZF9, Q71WG7, A0ALU7, Q8Y449, B8DB29, E6MY99, P0A0U7, A1KT73, P0A0U6, P0DH56, A9M3Q2, Q5F9J3, B4RKA2, P49979, P49981, B4F1Q2, A4XXP5, B1JD29, B0KS64, Q4KHK4, Q9HXV4, Q02RF8, B7V109, A6V1A1, C3KEC6, A5W880, P0A137, P0A136, Q886R8, Q3KHE3, Q1IDV1, Q48F36, Q4ZWV2, B2UB85, Q8XWE1, Q8CRI0, Q5HM20, Q6G792, P99062, P65201, Q5HDX9, Q6GEK4, P65202, A4VYR4, A4VSH4 | |
| 1491 | PGCDHAGIATQ | *Fusobacterium nucleatum* | Q8RHK3 | P26640 |
| 1492 | PGDGIGPEI | *Bacillus clausii, Desulfovibrio vulgaris, Pseudomonas aeruginosa, Pseudomonas putida, Pseudomonas fluorescens, Pseudomonas fluorescens, Pseudomonas savastanoi, Pseudomonas syringae, Pseudomonas syringae, Staphylococcus haemolyticus, Staphylococcus saprophyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q5WEN4, Q726X1, Q51375, Q88LE5, Q3KF21, Q4KF05, Q48K97, Q4ZUZ4, Q884C0, Q4L7U1, Q49Z13, Q5HMF8, Q8CNL2, Q2FWK2, Q6GF15, Q6G7Q0, P65101, P65100, Q2YUF1, Q5HEE3, Q2FF66, Q8NVJ0 | P50213 |
| 1493 | PGLAHFLEH | *Pseudomonas syringae, Pseudomonas protegens, Pseudomonas aeruginosa, Pseudomonas putida* | Q88A79, P55174, Q9I2D2, Q88QV3 | O43847 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1494 | PGLGKTTLA | Desulfovibrio alaskensis, Desulfovibrio vulgaris, Desulfovibrio vulgaris | Q30YX7, P61531, A1VC44 | Q8WVB6 |
| 1495 | PGMVLTVEPG | Escherichia coli, Streptomyces lividans, Streptomyces coelicolor | P15034, P0A3Z2, P0A3Z1 | P12955 |
| 1496 | PGRVNLIGEH | Clostridium tetani | Q896X8 | P51570 |
| 1497 | PGRVNLIGEHTDYN | Fusobacterium nucleatum, Clostridium acetobutylicum, Clostridium beijerinckii | Q8RHD0, Q97EZ6, A6M1P8 | P51570 |
| 1498 | PGSGKGTQS | Parabacteroides distasonis | A6LD69 | Q9Y6K8 |
| 1499 | PGSSIMPGKVNP | Bacillus subtilis, Helicobacter pylori, Helicobacter pylori, Pseudomonas fluorescens, Pseudomonas aeruginosa, Pseudomonas aeruginosa, Streptomyces coelicolor, Streptomyces avermitilis | P26899, Q9ZLI5, P56149, P07346, Q51404, Q9HTD7, Q9FBN6, Q82ID7 | P07954 |
| 1500 | PGTGKTLLA | Akkermansia muciniphila | B2UMY1 | Q9Y4W6 |
| 1501 | PGTGKTLLAKA | Ralstonia pickettii, Uncultured termite | B2UE66, B1GZK7 | Q9Y4W6 |
| 1502 | PGVGQNLQDH | Rhizobium meliloti | P54223 | Q8NE62 |
| 1503 | PGYTHLQRAQ | Clostridium kluyveri, Clostridium kluyveri, Clostridium tetani, ptoclostridium difficile | B9E0B2, A5N6U3, P59616, Q182I5 | P04424 |
| 1504 | PGYTHLQRAQPI | Bacillus licheniformis | Q65G68 | P04424 |
| 1505 | PHGLGHFLG | Aeromonas salmonicida, Aeromonas hydrophila | A4STF0, A0KEL3 | P12955 |
| 1506 | PHLGASTKEAQ | Bacillus subtilis | P35136 | O43175 |
| 1507 | PHVNVGTIGHVDHG | Pseudomonas fluorescens, Pseudomonas syringae, Pseudomonas savastanoi, Pseudomonas fluorescens, Pseudomonas putida, Pseudomonas putida, Pseudomonas putida, Pseudomonas putida, Pseudomonas entomophila, Pseudomonas putida | C3K2X8, Q4ZMP2, Q48D34, Q3K5X4, B1JDW6, B0KK53, A5VXN3, Q88QP8, Q1IFW8, Q88QN7 | P49411 |
| 1508 | PIFHVNADD | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q931R8, A5ISU5, A7X295, A6U1N4, Q8NWR6, Q5HG06, A8Z3Z0, Q2FH25, Q2FYM1, Q6G9E8, A6QGW6, Q6GGZ5, P0C601, Q99U74, Q2YY05 | Q9ULD0 |
| 1509 | PIGRGQREL | Desulfovibrio alaskensis | Q313V8 | P25705 |
| 1510 | PIGRGQRELIIGDRQTGKT | Bacillus clausii, Clostridium kluyveri, Clostridium kluyveri, Clostridium beijerinckii, Desulfovibrio vulgaris, Desulfovibrio desulfuricans, Desulfovibrio maeticus | Q5WB76, B9DX63, A5N3H9, A6LQH4, B8DRD0, B8J437, C4XI08 | P25705 |
| 1511 | PIGRGQRELIIGDRQTGKTSIAIDTIINQ | Parabacteroides distasonis, Bacteroides fragilis, Bacteroides fragilis, Bacteroides thetaiotaomicron | A6L8N5, Q64UA4, Q5LD82, Q8A9U7 | P25705 |
| 1512 | PIIMVGPGTG | Bacillus subtilis, Bacillus subtilis | O32214, O08394 | Q9UBK8 |
| 1513 | PILTMPNDDITHPIPDLTG | Clostridium tetani | Q891P2 | P15313 |
| 1514 | PISAKLVAN | Rhizobium meliloti | Q92N73 | P11908 |
| 1515 | PISAKLVANM | Rhizobium loti | Q98HW3 | P11908 |
| 1516 | PISAKLVANML | Neisseria meningitidis, Neisseria meningitidis | P65235, P65234 | P11908 |
| 1517 | PIWEQTGRGER | Geobacter metallireducens, Geobacter sulfurreducens, Geobacter bemidjiensis, Geobacter daltonii, Geobacter uraniireducens, Geobacter sp. | Q39UH2, Q74C82, B5EI27, B9M0Y1, A5GFA0, C6E2T0 | Q16740 |
| 1518 | PIVYTPTVG | Bacillus subtilis | O34389 | P48163 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1519 | PKDKPRYLMGVG | Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | B9DNG7, Q2YT91, A8Z2G7, P66906, Q6G8T0, P66905, A60HI1, Q6GG65, P66904, A5ITG3, Q5HFC4, Q2FXT6, Q2FG88, A7X354, A6U2A7, Q5HNR2, Q8CML7 | Q9BXR0 |
| 1520 | PKGFGGVQVSPP | Aeromonas hydrophila | P41131 | P04746 |
| 1521 | PKGVLLYGPPG | Bifidobacterium animalis, Bifidobacterium animalis, Bifidobacterium animalis, Bifidobacterium animalis | C6A7B2, C6AHX0, B8DTX4, D3R4I7 | Q8NBU5 |
| 1522 | PKILLLDEP | Bacillus cereus, Bacillus cereus, Pseudomonas aeruginosa | O31339, Q81GU1, Q9I6L0 | Q8WWZ7 |
| 1523 | PLFILYTSGSTGKPKGV | Ralstonia pickettii, Ralstonia solanacearum | B2U6V1, Q8XY11 | Q9NR19 |
| 1524 | PLGVCVGIGAWNYP | Rhizobium leguminosarum | Q1MJU3 | P49189 |
| 1525 | PLHVCEQRD | Bacillus subtilis | O06735 | O43252 |
| 1526 | PLIGFAGAP | Streptomyces griseus, Streptomyces avermitilis, Streptomyces coelicolor | B1WVH6, Q82KY4, Q69861 | P06132 |
| 1527 | PLKGARIAG | Corynebacterium glutamicum, Corynebacterium glutamicum, Corynebacterium efficiens, Ralstonia solanacearum, Ralstonia pickettii | A4QQ87, Q8NSC4, Q8FRJ4, Q8Y387, B2U774 | P23526 |
| 1528 | PLRGKILNV | Bacillus subtilis, Bacillus halodurans, Campylobacter jejuni, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus aureus, Staphylococcus aureus | P05652, O50627, O87667, P0A0K7, P0A0K8, Q6GD85, Q2FKQ1, P66937, P66936, Q8CQK4, Q5HK03, Q6GKU0, Q5HJZ1 | P11388 |
| 1529 | PLSVELGPG | Clostridium novyi, Clostridium botulinum, Clostridium botulinum, Clostridium botulinum, Clostridium botulinum, Clostridium thermocellum | A0PZC6, B1IJM8, A7GGL4, B1KXT6, A5I557, A7FWQ7, A3DHP0 | P38606 |
| 1530 | PLTGRTHQIR | Helicobacter pylori, Helicobacter pylori | Q9ZMA1, QO5114 | Q8IZ73 |
| 1531 | PLTLGGDHTIT | Pseudomonas aeruginosa | Q9I3S3 | Q9BSE5 |
| 1532 | PLVVRLEGTNV | Bacillus pumilus, Bacillus licheniformis, Bacillus methylotrophicus, Bacillus subtilis | A8FD73, Q65JP0, A7Z4M9, P80886 | Q96199 |
| 1533 | PMGWDAFGLPAE | Bacillus licheniformis, Bacillus subtilis, Bacillus halodurans, Haemophilus ducreyi, Streptococcus pneumoniae, Streptococcus pneumoniae, Streptococcus pneumoniae, Streptococcus pneumoniae, Streptococcus suis, Streptococcus suis, Streptococcus pneumoniae, Streptococcus pneumoniae, Streptococcus pneumoniae, Streptococcus thermophilus, Streptococcus thermophilus, Streptococcus thermophilus, Streptococcus pneumoniae, Streptococcus pneumoniae | Q65FX8, P36430, Q9K758, Q7VM66, B2IS10, C1CPD0, B1I8Y2, C1CID7, A4VY58, A4W4F3, C1CC47, Q97SS0, B8ZKS5, Q03MJ2, Q5M657, Q5M1L6, B5E6T0, Q8DRB6, Q04MJ2, C1CB31, P67515, P67514, Q3JYR6, A3CKP1, A8AZ43, B4U0A1, C0M8N3, Q8P2T2, Q1JNR2, Q1JDV2, | Q15031 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Streptococcus pneumoniae, Streptococcus pneumoniae, Streptococcus agalactiae, Streptococcus agalactiae, Streptococcus agalactiae, Streptococcus sanguinis, Streptococcus gordonii, Streptococcus equi, Streptococcus equi, Streptococcus pyogenes, Streptococcus pyogenes, Streptococcus pyogenes, Streptococcus pyogenes, Streptococcus mutans, Streptococcus pyogenes, Streptococcus equi, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes | Q1JIV9, Q8DS85, Q5XE35, C0MET9, P0DG45, P0DG44, A2RCB2, Q9A1P0, B5XJI9, Q48VJ7, Q1J8Q8 | |
| 1534 | PMGWDAFGLPAENAA | Clostridium thermocellum, Desulfovibrio vulgaris, Desulfovibrio vulgaris, Desulfovibrio alaskensis, Desulfovibrio vulgaris, Stenotrophomonas maltophilia, Stenotrophomonas maltophilia | A3DEU0, A1VEL2, Q72CT7, Q30YL0, B8DJF0, B2FPR7, B4SRE7 | Q15031 |
| 1535 | PNVGKSSFI | Geobacter sulfurreducens, Geobacter metallireducens | Q74702, Q39QR4 | Q9BZE4 |
| 1536 | PNVGKSSIIN | Clostridium phytofermentans, Eubacterium eligens | A9KLK7, C4Z0C8 | Q9BVP2 |
| 1537 | PNVGKSSLIN | Eubacterium rectale, Clostridium tetani, Clostridium botulinum, Clostridium perfringens, Clostridium perfringens, Clostridium perfringens, Clostridium botulinum, Clostridium kluyveri, Clostridium kluyveri, Clostridium beijerinckii, Clostridium botulinum, Clostridium botulinum, Clostridium thermocellum, Clostridium novyi, Clostridium botulinum, Clostridium botulinum, Clostridium botulinum, Clostridium botulinum, Clostridium botulinum, Enterococcus faecalis, Finegoldia magna, Helicobacter pylori, Helicobacter pylori, Streptococcus uberis | C4ZD63, Q895X8, B2THQ9, Q0SS66, Q8XJK1, Q0TPJ9, B2V3Z1, A5N7W7, B9E1C8, A6LSI6, A5I4V0, A7FW89, A3DE77, A0Q125, B1KX71, B1IIN2, C1FSU2, A7GGA7, C3L0M1, Q834T4, B051N2, Q9ZLF3, O25396, B9DTQ3 | Q9NVN8 |
| 1538 | PNVTDIVSIARAA | Desulfovibrio maeticus | C4XPD6 | Q12882 |
| 1539 | PPKGVLLYGPPG | Bifidobacterium dentium, Bifidobacterium adolescentis, Bifidobacterium longum, Bifidobacterium longum, Bifidobacterium longum, Corynebacterium jeikeium, Corynebacterium urealyticum | D2Q9C6, A1A0U4, B7GUP3, B3DRN4, Q8G3G6, Q4JVP5, B1VDV2 | Q8NBU5 |
| 1540 | PPKGVLLYGPPGCGKTLIAKA | Corynebacterium glutamicum, Corynebacterium glutamicum, Corynebacterium efficiens, Corynebacterium diphtheriae, Streptomyces scabiei, Streptomyces avermitilis, Streptomyces coelicolor | Q8NQD8, A4QE83, Q8FTE3, Q6NH92, C9Z319, Q828J2, Q9RJ58 | Q8NBU5 |
| 1541 | PPPNVTGSLH | Sphingomonas elodea | Q7X2N3 | P26640 |
| 1542 | PQDATTNPSLIL | Haemophilus somnus, Haemophilus influenzae, Haemophilus influenzae, Haemophilus influenzae, Haemophilus influenzae, Haemophilus ducreyi | Q01IU0, A5UIP9, P45055, A5UCY0, Q4QLG9, Q7VP02 | P37837 |
| 1543 | PQGTLAERIRAGGAG | Bacillus subtilis, Haemophilus influenzae | O34317, P44875 | P55809 |
| 1544 | PQILLLDEP | Escherichia coli, Escherichia coli, Escherichia coli | Q8FFB3, Q8XBJ8, P16676 | Q8N139 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1545 | PQNRVTDHRI | Lactobacillus helveticus, Lactobacillus gasseri, Lactobacillus acidophilus, Lactobacillus johnsonii, Lactobacillus fermentum, Lactobacillus delbrueckii, Lactobacillus delbrueckii, Lactobacillus brevis, Listeria monocytogenes, Listeria monocytogenes, Listeria monocytogenes, Listeria monocytogenes, Listeria welshimeri, Listeria innocua | A8YUJ1, Q042K5, Q5FKZ0, Q74K25, B2GAT1, Q1GAX5, Q04BB3, Q03QX7, Q8Y4A8, B8DBG6, Q71WN5, C1KYW0, A0ALM8, Q927V0 | Q9UGC7 |
| 1546 | PRFRGEHALRRYP | Methylobacterium extorquens, Methylobacterium radiotolerans, Methylobacterium extorquens, Methylobacterium populi | A9W1M5, B1LUM8, B7KQ58, B1ZA38 | O00217 |
| 1547 | PRNLAKSVTVE | Bacillus halodurans, Staphylococcus epidermidis, Staphylococcus epidermidis, Streptococcus pneumoniae, Streptococcus pneumoniae, Streptomyces coelicolor | Q9KG45, Q8CRL1, Q5HM69, Q97SQ9, Q8DRA8, Q86781 | Q06210 |
| 1548 | PSAFDRILASR | Clostridium novyi | A0PYC8 | Q01813 |
| 1549 | PSGAGKSTL | Ralstonia solanacearum | Q8XXF9 | Q16774 |
| 1550 | PTGGGKSLCYQLP | Bacillus subtilis | P50729 | P54132 |
| 1551 | PTQGMRQGND | Pseudomonas savastanoi, Pseudomonas mendocina, Pseudomonas syringae, Pseudomonas putida, Pseudomonas entomophila, Pseudomonas putida, Pseudomonas putida | Q48CJ2, A4XPS6, Q88AI5, B0KJ25, Q1I3L0, Q88QZ8, B1JE82 | Q9UJ68 |
| 1552 | PVDIYIPGC | Campylobacter concisus | A7ZBE5 | O75251 |
| 1553 | PVDLFPHTPH | Desulfovibrio vulgaris | Q72DK5 | Q96GJ1 |
| 1554 | PVFGICLGHQLLALA | Pseudomonas stutzeri | P38099 | P27708 |
| 1555 | PVFNTVKEA | Methylobacterium extorquens | P53595 | P53597 |
| 1556 | PVLGICYGM | Ralstonia solanacearum | Q8XZG4 | P49915 |
| 1557 | PVLGICYGMQ | Bacillus methylotrophicus, Bacillus subtilis, Bacillus licheniformis, Bacillus pumilus, Campylobacter jejuni, Campylobacter jejuni, Campylobacter jejuni, Campylobacter fetus, Campylobacter lari, Clostridium cellulolyticum, Desulfovibrio salexigens, Desulfovibrio vulgaris, Desulfovibrio vulgaris, Desulfovibrio alaskensis, Geobacter daltonii, Geobacter metallireducens, Geobacter sulfurreducens, Haemophilus influenzae, Haemophilus somnus, Haemophilus influenzae, Haemophilus ducreyi, Haemophilus parasuis, Neisseria meningitidis, Neisseria gonorrhoeae, Neisseria gonorrhoeae, Neisseria meningitidis, Proteus mirabilis, Pseudomonas putida, Pseudomonas putida, Pseudomonas putida, Pseudomonas entomophila, Pseudomonas mendocina, Staphylococcus epidermidis, Staphylococcus haemolyticus, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus carnosus, | A7Z235, P29727, Q65MU0, A8FAH5, A1W0N3, A7H2D2, Q9PN49, A0RQD7, B9KFL4, B8I4P0, C6BSD8, A1VEV0, Q72D86, Q31IX7, B9M9G4, Q39TA7, P60500, P44335, Q0I2D2, Q4QNW4, Q7VLE9, B8F3T2, Q9JXR2, Q5F4X9, B4RJH7, A9M138, B4EY59, B0KRE6, Q88P21, A5VZC3, Q1I5K9, A4XY17, Q8CMQ8, Q4L386, Q5HRX1, Q2YVL5, Q8NY69, Q6GC81, P64296, A5IPX0, Q6GJQ6, A7WY93, P99105, A6TYP2, B9DLM7, A6QE71, A8Z0R1, Q5HIQ6, Q2G0Y6, Q2FJM5, Q8DU81 | P49915 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Staphylococcus aureus, Staphylococcus aureus, Staphylococcus aureus, Staphylococcus aureus, Staphylococcus aureus, Streptococcus mutans* | | |
| 1558 | PVTLELGGKSP | *Acinetobacter sp., Escherichia coli, Pseudomonas sp., Streptomyces cattleya, Streptomyces coelicolor* | Q9FDS1, P37685, O86447, F8JX40, Q9RJZ6 | P51648 |
| 1559 | PVVAMVWEG | *Desulfitobacterium hafniense, Desulfitobacterium hafniense* | Q251Q1, B8FZD1 | O60361 |
| 1560 | PVVTIMGHVDHGKT | *Acinetobacter baumannii, Acinetobacter baumannii, Acinetobacter baumannii, Acinetobacter baumannii, Acinetobacter baumannii, Acinetobacter baylyi, Aeromonas hydrophila, Aeromonas salmonicida, Methylobacterium populi, Desulfovibrio alaskensis, Desulfovibrio vulgaris, Desulfovibrio vulgaris, Desulfovibrio desulfuricans, Edwardsiella ictaluri, Enterobacter cloacae, Geobacter uraniireducens, Geobacter sulfurreducens, Geobacter bemidjiensis, Geobacter lovleyi, Geobacter sp., Geobacter metallireducens, Geobacter daltonii, Haemophilus influenzae, Haemophilus influenzae, Haemophilus influenzae, Haemophilus influenzae, Haemophilus somnus, Haemophilus ducreyi, Klebsiella oxytoca, Klebsiella pneumoniae, Klebsiella pneumoniae, Rhizobium etli, Rhizobium leguminosarum, Rhizobium etli, Rhizobium loti, Sphingomonas wittichii, Stenotrophomonas maltophilia, Stenotrophomonas maltophilia* | B0VLU2, B0VE81, B2I2M7, B7I3R9, B7H115, Q6FF40, A0KNE3, A4SJR5, B1ZDQ8, Q30WJ0, A1VG83, Q72ER1, B8J1Y4, C5BFB7, Q9ZF25, A5GF86, Q74CT3, B5EI57, B3EAE7, C6E2Q0, Q39VA6, B9M1G0, Q4QK37, A5UF34, P44323, A5UBT6, Q0I3P5, Q7VLI2, Q9ZF28, B5XSX4, A6TEI7, Q2KDZ5, Q1MN39, B3PXE3, Q981318, A5VCZ5, B2FN90, B4SQS0 | P46199 |
| 1561 | PVVTIMGHVDHGKTTLLD | *Bacillus halodurans, Bacillus methylotrophicus, Bacillus subtilis, Lactobacillus helveticus, Bacillus pumilus, Bacillus licheniformis, Lactobacillus acidophilus, Bacillus clausii, Lactobacillus sakei, Lactobacillus delbrueckii, Lactobacillus delbrueckii, Lactobacillus gasseri, Lactobacillus johnsonii, Enterococcus faecalis, Enterococcus faecium, Leuconostoc citreum, Listeria monocytogenes, Listeria welshimeri, Listeria innocua, Listeria monocytogenes, Listeria monocytogenes, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae* | Q9KA77, A7Z4T4, P17889, A8YVQ7, A8FDD1, Q65JI1, Q5FJN6, Q5WFU2, Q38W81, Q049V5, Q1G9P9, Q04467, Q74IS8, Q835U8, P18311, B1MZH4, B8DG02, A0AIC6, Q92C29, Q71ZZ7, C1L2N1, Q8Y7F6, B8ZM93, B5E266, B2IME4, C1CCT8, Q8DQV2, Q04LW0, C1CQ48, C1C5S8, C1CJ39, Q97S57, B1IA80 | P46199 |
| 1562 | PVVTIMGHVDHGKTTLLDK | *Lactobacillus salivarius* | Q1WUF4 | P46199 |
| 1563 | PWGKGRPGWHIECS | *Lactobacillus reuteri, Lactobacillus reuteri, Lactobacillus casei,* | B2G555, A5VI99, Q035S0, B3WA35, | P49589 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Lactobacillus casei, Lactobacillus sakei, Lactobacillus gasseri, Lactobacillus helveticus, Lactobacillus johnsonii, Lactobacillus acidophilus, Lactobacillus delbrueckii, Lactobacillus delbrueckii, Clostridium acetobutylicum, Enterococcus faecalis, Leuconostoc citreum, Pseudomonas mendocina, Streptococcus agalactiae, Streptococcus agalactiae, Streptococcus agalactiae | Q38UZ6, Q045X8, A8YTD3, Q74L26, Q5FM34, Q048S9, Q1G8Z0, Q97ED6, Q839V5, B1MW68, A4XVG1, Q8E7F2, Q8E1Z4, Q3K3G5 | |
| 1564 | PWGKGRPGWHIECSAM | Bacillus subtilis, Bacillus methylotrophicus, Bacillus halodurans, Desulfitobacterium hafniense, Desulfitobacterium hafniense, Geobacter uraniireducens, Geobacter lovleyi, Geobacter daltonii, Haemophilus parasuis, Uncultured termite | Q06752, A7Z0L6, Q9KGF4, B8G1U2, Q250Q6, A5G949, B3E1P0, B9LZV4, B8F392, B1GYT2 | P49589 |
| 1565 | PWGKGRPGWHIECSAMA | Bacillus cytotoxicus, Bacillus weihenstephanensis, Bacillus licheniformis, Clostridium thermocellum | A7GK01, A9VNA2, Q65PC8, A3DH43 | P49589 |
| 1566 | PWTIPANEA | Lactobacillus helveticus, Lactobacillus acidophilus | A8YUP7, Q5FKU5 | Q9NSE4 |
| 1567 | PWTIRQYAGFST | Escherichia coli, Streptomyces cinnamonensis | P27253, Q05065 | P22033 |
| 1568 | PWVRNIFIVT | Neisseria meningitidis | Q51151 | Q3T906 |
| 1569 | PYPSGKLHMGHVR | Ralstonia solanacearum, Ralstonia pickettii | Q8XVT3, B2UCA1 | Q15031 |
| 1570 | PYVSGFLAFRE | Bacillus methylotrophicus, Bacillus subtilis | A7Z9I5, P96724 | Q8N8Q3 |
| 1571 | QAHGLCFSV | Bacteroides vulgatus, Bacteroides fragilis, Bacteroides fragilis, Bacteroides thetaiotaomicron | A6L7T5, Q64PM3, Q5L9D9, Q8A5V6 | P13051 |
| 1572 | QAHGLCFSVQ | Pseudomonas aeruginosa, Pseudomonas aeruginosa, Pseudomonas aeruginosa, Pseudomonas aeruginosa | B7UYZ2, A6VAM7, Q9I5H9, Q02HQ1 | P13051 |
| 1573 | QCGTIQLDF | Haemophilus parasuis | B8F5H9 | Q9BW92 |
| 1574 | QDDAHIFCT | Acinetobacter baumannii, Acinetobacter baumannii, Acinetobacter baumannii, Acinetobacter baumannii, Acinetobacter baumannii, Aeromonas hydrophila, Aeromonas salmonicida, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Haemophilus ducreyi, Haemophilus somnus, Haemophilus influenzae, Haemophilus influenzae, Haemophilus influenzae, Haemophilus influenzae, Klebsiella pneumoniae, Neisseria gonorrhoeae, Neisseria meningitidis, Neisseria meningitidis, Neisseria meningitidis, Proteus mirabilis, Pseudomonas savastanoi, Pseudomonas syringae, Pseudomonas syringae, Pseudomonas aeruginosa, | B2HTH0, B7H005, B0V5P2, A3M299, B7I688, A0KKP9, A4SMA4, C5B846, A4W9M3, Q1RB76, B1LE12, B7N556, P0A8M3, P0A8M4, Q0THB0, A1ABQ2, B1XGI1, C4ZYI1, B7MVJ7, B7NT58, B7MAS9, B7USA2, B7LQ71, B5YQ07, Q8XE27, B7M1C7, B6IBD7, B1IPK9, A8A0R2, B7L6J2, A7ZMI6, Q7VKR9, Q0I3M2, A5UBX5, Q4QK77, P43014, A5UEK1, B5XQC6, Q5F9U4, Q9K095, A9M375, Q9JVA3, B4ETK6, Q48JS3, Q4ZUG7, Q883H9, A6V485, B7V188, Q9I099, Q02NP1, Q3KEY2, A4VM22, B1J6U4, A4XTS1, C3JZN7, Q88K27, B0KKR8, A5W5E1, Q1IC15, Q8XZ29, Q1MGA7 | A2RTX5 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Pseudomonas aeruginosa, Pseudomonas aeruginosa, Pseudomonas aeruginosa, Pseudomonas fluorescens, Pseudomonas stutzeri, Pseudomonas putida, Pseudomonas mendocina, Pseudomonas fluorescens, Pseudomonas putida, Pseudomonas putida, Pseudomonas putida, Pseudomonas entomophila, Ralstonia solanacearum, Rhizobium leguminosarum* | | |
| 1575 | QDFTGVPAVVD | *Escherichia coli, Pseudomonas aeruginosa* | P25516, Q9I3F5 | P21399 |
| 1576 | QDPLAELVKI | *Escherichia coli* | P46837 | Q8N5C6 |
| 1577 | QDPLAELVKIEPK | *Haemophilus influenzae* | P71353 | Q8N5C6 |
| 1578 | QEEIFGPVL | *Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q7A1Y7, Q7A825, Q99X54, Q6GCV9, Q2G1J0, Q5HJK3, Q2FK94, Q6GKD8, Q2YV11 | P30838 |
| 1579 | QGARLTAFEL | *Clostridium phytofermentans, Desulfovibrio vulgaris, Desulfovibrio vulgaris* | A9KIE9, A1VHH2, Q72FX9 | Q9BV20 |
| 1580 | QGFFDIPVDNL | *Enterococcus faecalis, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus pneumoniae, Streptococcus pneumoniae, Streptococcus mutans* | Q832Z5, Q99ZR0, Q5XC85, P0DCQ0, P0DC01, Q8P137, Q8E568, Q8DZK4, P65241, P65242, Q8DU94 | P11908 |
| 1581 | QGMNAAVRAVVR | *Paenibacillus macquariensis* | Q59214 | Q01813 |
| 1582 | QGMRQGNDH | *Escherichia coli* | Q0T9G6 | Q9UJ68 |
| 1583 | QGMRQGNDHGTQYRSAIYP | *Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae* | B1LRA3, B7LMP0, B7NGF6, B7NUD2, B7MTA1, B7UQN3, P0A744, B1ISY2, A8A7X5, B1XDW8, C4ZR95, B7M9I1, B7LCT1, B7MLN1, A7ZV98, B5Z3H5, Q8XCG3, Q8FAG4, B5Y2Y3 | Q9UJ68 |
| 1584 | QGNDHGTQYRSAIYP | *Enterobacter sp.* | A4W5V5 | Q9UJ68 |
| 1585 | QGVLLLNAVLTV | *Leuconostoc mesenteroides* | Q03W63 | P13051 |
| 1586 | QGVLLLNAVLTVR | *Streptomyces avermitilis* | Q827B3 | P13051 |
| 1587 | QGVLLLNAVLTVRA | *Streptomyces coelicolor* | Q9K3Z0 | P13051 |
| 1588 | QHLFWFFGHPEVY | *Corynebacterium diphtheriae, Corynebacterium efficiens, Corynebacterium glutamicum* | Q6NFM3, Q8FMT1, Q79VD7 | P00395 |
| 1589 | QHLFWFFGHPEVY1 | *Streptomyces avermitilis, Streptomyces avermitilis, Streptomyces coelicolor, Streptomyces coelicolor* | Q82AK9, Q828X4, Q9X813, Q9K451 | P00395 |
| 1590 | QILTEPRNA | *Streptococcus pyogenes, Streptococcus pyogenes, Streptococcus pyogenes, Streptococcus pyogenes, Streptococcus pyogenes, Streptococcus pyogenes, Streptococcus pyogenes* | P0DA37, Q48U22, Q1J741, Q1JHC2, P63795, P0DA36, P63793 | O76031 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1591 | QIQGFFDIP | Bacillus subtilis, Bacillus caldolyticus, Bacillus cereus, Bacillus anthracis, Fusobacterium nucleatum, Corynebacterium ammoniagenes, Staphylococcus haemolyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus | P14193, P42816, Q81J97, Q81VZ0, Q8RHM2, O33924, Q4L3F7, Q8CQU7, Q5HRQ5, Q5HIH5, Q6GJH1, P65237, P65238, Q6GBY8, P65236 | P11908 |
| 1592 | QIQGFFDIPVD | Bacillus halodurans, Lactobacillus plantarum, Clostridium acetobutylicum, Streptococcus pyogenes, Streptococcus pyogenes, Streptococcus pyogenes, Streptococcus pyogenes, Streptococcus pyogenes, Streptococcus pneumoniae, Streptococcus pneumoniae, Streptococcus agalactiae, Streptococcus agalactiae, Streptococcus mutans | Q9KGJ5, Q88VA5, Q97E93, P0DB99, P65245, Q5XEL0, P0DB98, P65243, P65240, P65239, Q8E2H0, Q8E7X8, Q8DWM2 | P11908 |
| 1593 | QIQGFFDIPVDN | Pseudomonas aeruginosa, Ralstonia solanacearum | Q9HVC5, Q8Y2E1 | P11908 |
| 1594 | QIQGFFDIPVDNLY | Helicobacter hepaticus | Q7VFY9 | P11908 |
| 1595 | QIQNALGSDI | Listeria innocua, Listeria welshimeri, Listeria monocytogenes, Listeria monocytogenes, Listeria monocytogenes, Listeria monocytogenes | Q92B14, A0AIX9, B8DHL8, Q8Y700, Q71ZE0, C1KVH7 | Q9BXR0 |
| 1596 | Q1YRIDHYLGKE | Aggregatibacter actinomycetemcomitans | P77809 | P11413 |
| 1597 | QKEVAERLAA | Lactobacillus delbrueckii, Lactobacillus delbrueckii, Parabacteroides distasonis | Q04C60, Q1GBR1, A6LF39 | Q8WVM0 |
| 1598 | QKEVAERLAAN | Lactobacillus salivarius | Q1WV73 | Q8WVM0 |
| 1599 | QKGTGRARH | Rhizobium loti, Rhizobium leguminosarum, Rhizobium etli, Rhizobium leguminosarum, Rhizobium etli, Rhizobium meliloti, Rhizobium sp. | Q98N56, B5ZYT6, Q2K9L5, Q1MIE0, B3PWS2, Q92QG9, C3MAY1 | Q9BYD3 |
| 1600 | QLDTPERGFS | Clostridium novyi, Clostridium phytofermentans | A0Q055, A9KM86 | A6NJ78 |
| 1601 | QLKGAGPTPFSR | Rhizobium leguminosarum, Rhizobium etli, Rhizobium leguminosarum | B5ZUP2, B3PTN1, Q1MJK8 | Q9BVL4 |
| 1602 | QLKQFTTVVADTGD | Pseudomonas stutzeri, Pseudomonas putida, Pseudomonas putida, Pseudomonas putida, Pseudomonas entomophila, Pseudomonas mendocina | A4VK43, Q88KX1, B1J623, B0KHA7, Q1I7G7, A4XTM7 | P37837 |
| 1603 | QLKQFTTVVADTGDF | Pseudomonas fluorescens | Q3K9H0 | P37837 |
| 1604 | QLSGGQKQR | Bacillus subtilis, Bacillus anthracis, Bacillus cereus, Bacillus thuringiensis, Bacillus halodurans, Bifidobacterium longum, Corynebacterium glutamicum, Corynebacterium jeikeium, Corynebacterium efficiens, Enterococcus faecalis, Listeria innocua, Listeria monocytogenes, Listeria monocytogenes, Propionibacterium acnes | O34900, Q81ZF5, Q81IN8, Q6HP89, Q9K789, Q8G5P8, Q8N5N2, Q4JTG9, Q8FRX8, Q831K6, Q92EZ6, Q724C0, Q8YA75, Q6A6X6 | Q2M3G0 |
| 1605 | QLSGGQKQRV | Bacillus licheniformis, Bacillus clausii, Bacillus cereus, Bacillus subtilis, Bacillus cereus, Fusobacterium nucleatum, Desulfitobacterium hafniense | Q65F80, Q5WDP1, Q73EL7, O32169, Q63GR8, Q8RFN2, Q24I5 | Q9NP78 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1606 | QLSGGQKQRVA | Leuconostoc mesenteroides, Pediococcus ntosaceus | Q03Z27, Q03EE4 | Q9NP78 |
| 1607 | QLYQRSGDM | Lactobacillus gasseri, Lactobacillus acidophilus, Lactobacillus delbrueckii, Lactobacillus delbrueckii, Lactobacillus johnsonii | Q044A1, Q5FKL6, Q041329, Q1GAP2, Q74IU3 | P04818 |
| 1608 | QMQYNLRLR | Ralstonia solanacearum | Q8Y270 | Q6PI48 |
| 1609 | QPPKGVLLYGPP GCGKTLIAKA | Corynebacterium aurimucosum, Corynebacterium kropnstedtii | C3PGA0, C4LIL2 | Q8NBU5 |
| 1610 | QREDDKPETV | Streptococcus mutans, Streptococcus sanguinis, Streptococcus thermophilus, Streptococcus thermophilus, Streptococcus thermophilus, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus equi, Streptococcus equi, Streptococcus gordonii, Streptococcus pyogenes, Streptococcus pyogenes, Streptococcus pyogenes, Streptococcus pyogenes, Streptococcus agalactiae, Streptococcus agalactiae, Streptococcus uberis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus agalactiae | Q8D533, A3CK85, Q5LXT2, Q5M2D4, Q03IH2, C1CAN3, Q97SU1, B2IS63, B5E6H6, C1CPA9, C1CIB8, B1I8L9, C1CC27, Q04ML5, Q8DRD4, B8ZKQ1, C0ME26, C0M6X3, A8AZK4, P69882, Q1J8Z2, P0DB92, P0DB93, P65204, P65203, B9DSX1, Q1JJ40, Q48V58, B5XJ57, Q1JE38, Q1JNZ6, Q8P2Z4, Q5XEB4, A2RC35, Q3K3U8 | Q9UIJ7 |
| 1611 | QRIAIARAL | Escherichia coli, Escherichia coli, Escherichia coli, Escherichia coli, Escherichia coli, Proteus vulgaris | Q47258, Q8FDZ8, P10089, P08716, Q46717, P11599 | Q9NRK6 |
| 1612 | QRIAIARALV | Clostridium novyi, ptoclostridium difficile | A0PY57, Q18AM3 | Q2M3G0 |
| 1613 | QRLAIARAL | Haemophilus influenzae, Haemophilus ducreyi, Haemophilus influenzae, Haemophilus somnus, Haemophilus influenzae, Pseudomonas aeruginosa, Pseudomonas fluorescens, Pseudomonas putida, Pseudomonas fluorescens, Pseudomonas savastanoi, Pseudomonas syringae, Pseudomonas syringae | Q40PI4, Q7VL52, P44407, Q0I4C5, P45082, Q9HUG8, Q3KJ31, Q88D92, Q4KJB2, Q48P40, Q4ZZ16, Q87VF3 | Q9NUT2 |
| 1614 | QRQATKDAG | Bacillus clausii, Bacillus halodurans, Lactobacillus acidophilus, Lactobacillus brevis, Bifidobacterium adolescentis, Clostridium thermocellum, Clostridium acetobutylicum, Clostridium kluyveri, Clostridium kluyveri, Clostridium beijerinckii, Clostridium tetani, Clostridium botulinum, Clostridium botulinum, Clostridium botulinum, Clostridium botulinum, Clostridium botulinum, Clostridium botulinum, Clostridium botulinum, Corynebacterium urealyticum, Geobacter sulfurreducens, Geobacter metallireducens, Geobacter lovleyi, | Q5WHG1, Q9KD72, Q84BU4, Q03QU1, A1A3P5, A3DF25, P30721, B9E041, A5N6M2, A6LRN4, Q892R0, B1KZN7, A7GHH6, C1FVU0, A5I640, A7FXL5, B1ILM3, C3L3G7, B1VHX4, Q74H59, Q39PT7, B3E7W9, B9M357, A5GDC8, C6E643, B5EC42, A1KSG3, Q9K0N4, Q5F6W5, A9M296, Q9JVQ9, Q3KIA0, | P11021 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Geobacter daltonii, Geobacter uraniireducens, Geobacter sp., Geobacter bemidjiensis, Neisseria meningitidis, Neisseria meningitidis, Neisseria gonorrhoeae, Neisseria meningitidis, Neisseria meningitidis, Pseudomonas fluorescens, Pseudomonas mendocina, Pseudomonas aeruginosa, Pseudomonas aeruginosa, Pseudomonas aeruginosa, Pseudomonas aeruginosa, Pseudomonas putida, Pseudomonas putida, Pseudomonas syringae, Pseudomonas entomophila, Pseudomonas putida, Pseudomonas savastanoi, Pseudomonas syringae, Pseudomonas fluorescens, Pseudomonas putida, Pseudomonas stutzeri, Ralstonia pickettii, Ralstonia solanacearum, Stenotrophomonas maltophilia, Stenotrophomonas maltophilia | A4XYF6, B7V1H3, Q9HV43, Q02FR1, A6VCL8, Q88DU2, A5W9A3, Q4ZNP7, Q1IF59, B1J254, Q48E62, Q87WP0, Q4KIH1, B0KIS5, A4VPQ5, B2UBP3, Q8XW40, B2FMY5, B4SSQ6 | |
| 1615 | QRRQALRQLDG | Methylobacterium radiotolerans | B1M0E0 | Q969Y2 |
| 1616 | QRVAIARAI | Lactobacillus gasseri, Lactobacillus johnsonii, Lactobacillus delbrueckii, Lactobacillus acidophilus, Lactobacillus delbrueckii, Lactobacillus salivarius, Enterococcus faecalis, Listeria monocytogenes, Listeria monocytogenes, Listeria welshimeri, Listeria innocua, Streptococcus mutans | Q042G7, Q74K65, Q1GB17, Q5FL41, Q04BG2, Q1WV17, Q830W6, Q8Y8T6, Q72261, A0AGP9, Q92DL6, Q8DUF7 | O75027 |
| 1617 | QRVTRASVTV | Citrobacter koseri, Enterobacter sp., Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli | A8AL53, A4WGB6, B7N2M8, B7LVG2, Q1R431, B1LMS1, B6I4M4, B7NFI6, P0A6M4, A8A6Y8, B1IVJ1, Q0TAH5, P0A6M5, A1A164, C5A055, B1X1355, B7M686, B5YZ24, B7MI18, P0A6M6, B7L9D6, B7UNK4, A7ZU92, B7NUY4 | Q8TEA8 |
| 1618 | QSLAIIEYL | Rhizobium meliloti | Q9X4F7 | O43708 |
| 1619 | QSPDIAQGV | Streptomyces griseus, Streptomyces coelicolor | B1W470, Q9L0Y3 | P31153 |
| 1620 | QSSNDTFPTA | Corynebacterium glutamicum, Corynebacterium efficiens | Q8NRN8, Q8FQP8 | P07954 |
| 1621 | QTLLFSATMP | Bacillus licheniformis, Bacillus subtilis, Bacillus cereus, Bacillus thuringiensis, Bacillus thuringiensis, Bacillus anthracis, Bacillus cereus, Bacillus cereus | Q65N62, P96614, Q73EU1, Q6HPE6, A0R8U6, Q81VG0, Q63GX5, Q81IT9 | Q9UJV9 |
| 1622 | QTREQHIRR | Pseudomonas aeruginosa, Pseudomonas fluorescens, Pseudomonas fluorescens, Pseudomonas putida | Q9II37, C3JYR1, Q3K7X5, Q88P65 | P23378 |
| 1623 | QVDTTNILF | Leuconostoc citreum, Rhizobium leguminosarum, Rhizobium meliloti, Rhizobium leguminosarum, Rhizobium etli, Rhizobium etli, Rhizobium sp. | B1MXT8, Q1MIM6, Q92QQ2, B5ZY09, Q2K9U6, B3PVY5, C3MA45 | O76Q31 |
| 1624 | QVEHPVTEMITG | Escherichia coli, Escherichia coli, Haemophilus influenzae | P24182, Q8X9B6, P43873 | Q96R03 |
| 1625 | QVVAPSDMMDGR | Pseudomonas aeruginosa | Q59643 | P13716 |
| 1626 | QVVGDEGKGK | Arcobacter butzleri, Lactobacillus plantarum, Lactobacillus salivarius, Lactobacillus reuteri, Lactobacillus reuteri, Lactobacillus helveticus, | A8ER43, Q88SV6, Q1WRH2, B2G550, A5VHM0, A8YTK4, A7ZAP4, Q74KY3, | Q8N142 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Bacillus methylotrophicus, Lactobacillus johnsonii, Bacillus licheniformis, Bacillus clausii, Bacillus cytotoxicus, Lactobacillus brevis, Lactobacillus gasseri, Bacillus pumilus, Bacillus halodurans, Lactobacillus fermentum, Bacillus anthracis, Bacillus thuringiensis, Bacillus thuringiensis, Bacillus cereus, Bacillus cereus, Bacillus cereus, Bacillus subtilis, Fusobacterium nucleatum, Fusobacterium nucleatum, Campylobacter hominis, Campylobacter fetus, Campylobacter lari, Campylobacter concisus, Campylobacter curvus, Citrobacter koseri, Clostridium thermocellum, Clostridium kluyveri, Clostridium cellulolyticum, Desulfovibrio salexigens, Enterobacter sp., Enterococcus faecalis, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Helicobacter pylori, Helicobacter pylori, Helicobacter pylori, Helicobacter pylori, Helicobacter pylori, Helicobacter pylori, Helicobacter acinonychis, Klebsiella pneumoniae, Klebsiella pneumoniae, Leuconostoc mesenteroides, Leuconostoc citreum, Listeria monocytogenes, Listeria monocytogenes, Listeria monocytogenes, Listeria monocytogenes, Listeria welshimeri, Listeria innocua, Pediococcus ntosaceus, Porphyromonas gingivalis, Propionibacterium acnes, Proteus mirabilis, Pseudomonas fluorescens, Pseudomonas mendocina, Pseudomonas putida, Pseudomonas putida, Pseudomonas putida, Pseudomonas putida, Pseudomonas fluorescens, Pseudomonas aeruginosa, Pseudomonas aeruginosa, Pseudomonas aeruginosa, Pseudomonas entomophila, Pseudomonas fluorescens, Pseudomonas aeruginosa, Pseudomonas syringae, Pseudomonas savastanoi, Pseudomonas syringae, Rhizobium loti, Rhizobium meliloti, Rhizobium etli, Rhizobium etli, Rhizobium sp., Rhizobium leguminosarum, Rhizobium leguminosarum, Staphylococcus epidermidis, Staphylococcus epidermidis, Staphylococcus haemolyticus, Streptococcus pyogenes, Streptococcus pyogenes, Streptococcus pyogenes, Streptococcus pyogenes, Streptococcus pyogenes, | Q65CR5, Q5WAI0, A7GVN0, Q03TS9, Q045S7, A8FJC0, Q9K5R0, B2GEZ1, Q81JI9, A0RLP6, Q6HAG9, Q72WW1, Q630D5, Q814H1, P29726, O68581, P58793, A7I328, A0RMY9, B9KF91, A7ZFJ4, A7H0A8, A8AMM3, A3DK09, A5N4D3, B815L3, C6BRT2, A4W5R8, Q839Y4, B1LQJ7, Q1R383, B1IT29, B1XDS8, B7NGB1, A1AJ82, B7MSJ5, B7LLV9, Q0T9L6, P0A7D4, B7M8T7, P0A7D5, B6I281, B7NTN3, A8A7S2, B7UQI6, B7LC36, C4ZR54, B5Z2I3, P0A7D6, B7MKY1, A7ZV47, B6JKI4, Q1CUP8, B5ZA21, Q9ZMI1, P56137, B2US87, Q17W85, A6TH93, B5Y325, Q03W69, B1N002, B8DAL0, Q725A8, C1KV62, Q8YAR1, A0AEN2, Q92FQ5, Q03ET4, Q7MWW8, Q6A6A3, B4F271, Q4KJ68, A4XPZ3, B1JA10, Q88DD8, A5W9S5, B0KKZ0, Q3KIY4, B7V2O1, Q02F80, Q9HUM6, Q1I454, C3KDW8, A6VD51, Q4ZYX5, Q48NZ7, Q87VJ9, Q98F97, Q92MA5, Q2K4X9, B3PY13, C3MI14, Q1MCS2, B5ZMS8, Q5HK16, Q8CQK1, Q4LAK0, Q9A1P8, Q1J8S0, Q48VK8, Q1JIX0, P0DD55, P0DD54, Q5M2A7, Q5LXQ5, C0MFY0, B9DT31, Q03IE5, Q8P2U1, Q5XE45, C0MAE4, A2RCA2, Q1JNS3, B5XJH8, A8AZM9, Q8DW14, Q04N48, P65887, B8ZJJ5, P65888, A3CQU5, P65885, P65886, Q3JZ68, A4W440 \*\*\*\* | |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Streptococcus pyogenes, Streptococcus thermophilus, Streptococcus thermophilus, Streptococcus equi, Streptococcus uberis, Streptococcus thermophilus, Streptococcus pyogenes, Streptococcus pyogenes, Streptococcus equi, Streptococcus pyogenes, Streptococcus pyogenes, Streptococcus pyogenes, Streptococcus gordonii, Streptococcus mutans, Streptococcus pneumoniae, Streptococcus pneumoniae, Streptococcus pneumoniae, Streptococcus pneumoniae, Streptococcus sanguinis, Streptococcus agalactiae, Streptococcus agalactiae, Streptococcus agalactiae, Streptococcus suis | | |
| 1627 | QWGDEGKGKV | Desulfitobacterium hafniense, Desulfitobacterium hafniense, ptoclostridium difficile, Uncultured termite | B8G0I5, Q24MC6, Q18107, B1H0H8 | Q8N142 |
| 1628 | QWGDEGKGKVVD | Parabacteroides distasonis, Bacteroides fragilis, Bacteroides fragilis, Bacteroides vulgatus, Bacteroides thetaiotaomicron, Campylobacter jejuni, Campylobacter jejuni, Campylobacter jejuni, Campylobacter jejuni, Campylobacter jejuni, Helicobacter hepaticus | A6LIF5, Q64QR7, Q5LAD5, A6L1X1, Q8A6N4, Q5H5T3, A7H5L7, A1W1A5, A8FNG4, Q9PMG4, Q7VHL2 | Q8N142 |
| 1629 | QWGDEGKGKVVDLL | Edwardsiella ictaluri | O31047 | Q8N142 |
| 1630 | QYHPEFLSRP | Lactobacillus helveticus, Lactobacillus delbrueckii | A8YXF8, Q1GBQ2 | P17812 |
| 1631 | QYLAAAGVG | Haemophilus influenzae | P45211 | O95396 |
| 1632 | RAAVPSGASTG | Clostridium kluyveri, Clostridium kluyveri, Clostridium beijerinckii, Clostridium botulinum, Clostridium botulinum, Desulfovibrio vulgaris, Desulfovibrio vulgaris, Geobacter uraniireducens, Geobacter daltonii, Geobacter sp., Geobacter bemidjiensis, Geobacter metallireducens, Geobacter sulfurreducens, Geobacter lovleyi, Stenotrophomonas maltophilia, Stenotrophomonas maltophilia | A5N2N5, B9E6B1, A6LR09, B2TPW4, B2UY16, A1VGV5, Q72F92, A5GEW5, B9M3M1, C6E471, B5EGF2, Q39T27, Q74AR6, B3E258, B2FK88, B45R86 | P06733 |
| 1633 | RAAVPSGASTGI | Clostridium tetani | Q898R0 | P06733 |
| 1634 | RAAVPSGASTGIYEA | Clostridium perfringens, Clostridium perfringens, Clostridium perfringens | Q0STE0, Q0TQZ2, Q8XKU4 | P06733 |
| 1635 | RAGGKHNDL | Aeromonas hydrophila, Aeromonas salmonicida, Arcobacter butzleri, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter uraniireducens, Haemophilus somnus, Haemophilus influenzae, Haemophilus influenzae, Haemophilus influenzae, Haemophilus ducreyi, Helicobacter pylori, Helicobacter pylori, Helicobacter acinonychis, Helicobacter pylori, Helicobacter pylori, Klebsiella pneumoniae, Neisseria meningitidis, Neisseria meningitidis, Neisseria gonorrhoeae, Neisseria meningitidis, Neisseria | A0KPG1, A4SS99, A8EWI6, A8ANQ1, A4WDQ6, A8A3H4, B1LQ15, Q1R804, A1AEN7, A7ZQC5, Q8X3W8, Q0TEI3, P00957, B1XCM5, B1IUY2, A5GD98, Q0I426, A5UHW6, Q4QM86, A5UDR0, Q7VLK0, Q1CS22, Q9ZJY5, Q17ZF3, P56452, B2UV04, A6TCV9, A9M198, A1KV20, Q5F7C4, Q9JTG4, Q9JYG6, A4VJB3, Q02I63, Q9IS53, A6VA71, A4XWE2, Q885J0, Q4K843, Q4ZQI4, | P49588 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | meningitidis, Pseudomonas stutzeri, Pseudomonas aeruginosa, Pseudomonas aeruginosa, Pseudomonas aeruginosa, Pseudomonas mendocina, Pseudomonas syringae, Pseudomonas fluorescens, Pseudomonas syringae, Pseudomonas entomophila, Pseudomonas fluorescens, Pseudomonas savastanoi, Pseudomonas putida, Pseudomonas putida, Pseudomonas putida, Pseudomonas putida, Ralstonia solanacearum | Q1I6Z8, Q3K892, Q48G25, B0KR43, Q88EI8, A5W0D9, B1JCG9, Q8Y193 | |
| 1636 | RAGGKHNDLD | Acinetobacter baumannii, Acinetobacter baumannii, Acinetobacter baumannii, Acinetobacter baylyi, Methylobacterium sp., Methylobacterium extorquens, Methylobacterium radiotolerans, Methylobacterium populi, Rhizobium meliloti, Rhizobium etli, Rhizobium leguminosarum, Rhizobium loti, Sphingomonas wittichii, Stenotrophomonas maltophilia | B0VAI3, A3M3W2, B2HWK7, Q6FCT2, B0UGC4, A9W5Y4, B1M0N0, B1ZC90, P27866, Q2K7T4, Q1MFZ9, Q98NQ5, A5V3L0, B2FL33 | P49588 |
| 1637 | RALFGTIDSWL | Sphingomonas wittichii | A5VE44 | Q14409 |
| 1638 | RASGAGGQH | Acinetobacter baumannii, Acinetobacter baumannii, Acinetobacter baumannii, Acinetobacter baumannii, Acinetobacter baumannii, Acinetobacter baumannii, Acinetobacter baylyi, Lactobacillus sakei, Neisseria meningitidis, Neisseria meningitidis, Neisseria meningitidis, Neisseria meningitidis, Neisseria gonorrhoeae, Neisseria gonorrhoeae, Ralstonia pickettii, Ralstonia solanacearum, Uncultured termite | B2HU82, A3M6N7, B0VM26, B0V7E0, B7IBA1, B7H0L9, Q6F9S2, Q38WJ4, Q9JY93, A1KV95, Q9JT75, A9M1Q8, Q5F750, B4RN52, B2UDM7, Q8XVD0, B1GZI5 | Q9UGC7 |
| 1639 | RASGAGGQHVN | Aeromonas salmonicida, Aeromonas hydrophila, Desulfovibrio desulfuricans, Desulfovibrio vulgaris, Desulfovibrio vulgaris, Desulfovibrio vulgaris, Geobacter metallireducens, Geobacter sulfurreducens, Pseudomonas entomophila, Pseudomonas putida, Pseudomonas putida, Pseudomonas putida, Pseudomonas putida | A4SK64, A0KMZ8, B8J4R4, A1VAK8, Q727E1, B8DLL6, Q39YQ1, Q74861, Q1IEX1, B1JEP6, Q88PW5, B0KNE4, A5VYG5 | Q9UGC7 |
| 1640 | RAVLHVALR | Ralstonia pickettii | B2UF65 | P06744 |
| 1641 | RAVLHVALRNR | Desulfovibrio maeticus, Neisseria meningitidis, Neisseria meningitidis, Neisseria gonorrhoeae | C4XST3, Q9JYX3, Q9JTW1, Q5F8P8 | P06744 |
| 1642 | RAVLHVALRNRSNTPI | Citrobacter koseri, Enterobacter sp., Klebsiella pneumoniae, Klebsiella pneumoniae | A8ANA6, A4W5E0, A6TGT4, B5XY03 | P06744 |
| 1643 | RAVLHVALRNRSNTPILVDGKDVMPEVN | Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli | B7LKZ8, B1LPI9, C5A0W2, B1IUM7, P0A6T1, P0A6T2, B7LAX0, B1XC24, B5Z0C4, Q8FB44, Q0TA36, Q1R3R3, B7MRF7, A1AIK3, B7NRZ0, B7UPI6, B7MJ15, B615N7, A8A7C4, A7ZUP3, B7M7T4, B7NFW8 | P06744 |
| 1644 | RDCSIQRRHQK | Bacillus halodurans | Q9KDS9 | O00763 |
| 1645 | RDCSVQRRHQK | Bacillus subtilis, Bacillus subtilis | O34544, Q9KWU4 | Q13085 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
| --- | --- | --- | --- | --- |
| 1646 | RDGFVMGEGA | Bacillus subtilis, Staphylococcus aureus, Staphylococcus aureus, Staphylococcus aureus, Staphylococcus aureus, Staphylococcus aureus, Staphylococcus aureus | O34340, Q8NXE1, Q6GAU2, Q5HHA1, Q7A6F8, Q99VA6, Q6GIA3, Q5TKS0 | Q9NWU1 |
| 1647 | RDGFVMGEGAAVLVLEE | Streptomyces cyaneus | Q02578 | Q9NWU1 |
| 1648 | RDGKLYGRGS | Acinetobacter baumannii, Acinetobacter baumannii, Acinetobacter baumannii, Acinetobacter baumannii, Acinetobacter baumannii, Acinetobacter baumannii | B0VRY3, B7GXA3, B0V4V8, B7I842, A3M8H2, B2HY23 | Q96KP4 |
| 1649 | RDHRKIGKE | Parabacteroides distasonis, Bacteroides fragilis, Bacteroides fragilis, Bacteroides vulgatus, Bacteroides thetaiotaomicron, Clostridium acetobutylicum, Porphyromonas gingivalis, Porphyromonas gingivalis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus carnosus, Staphylococcus aureus, Staphylococcus aureus, Staphylococcus aureus, Staphylococcus saprophyticus | A6L952, Q64VP2, Q5LEQ6, A6L7J7, Q8AAP2, Q97GK4, B2RJD6, Q7MVQ5, Q2FXP7, Q8NW68, A8Z2J8, Q6G8P3, Q6GG23, A6QHL6, Q5HF90, A5ITK7, Q2FG54, A6U2F0, Q2YTA7, B9DNC9, P67584, P67585, A7X3A6, Q49YB4 | A2RTX5 |
| 1650 | RDMKPENVL | Streptomyces toyocaensis | Q9KIG4 | Q8WTQ7 |
| 1651 | RDPRGFAVKFYTE | Pseudomonas putida | Q59714 | P04040 |
| 1652 | REGNDLYHEM | Clostridium botulinum, Clostridium botulinum | B2TKQ0, B2UZK0 | P06576 |
| 1653 | REILDSRGNPTVEVD | Porphyromonas gingivalis, Porphyromonas gingivalis | Q7MTV8, B2RLL7 | P09104 |
| 1654 | REKLDGLYECILCACCSTSCPS | Escherichia coli | P07014 | P21912 |
| 1655 | RELLAVPDNY | Ralstonia solanacearum | Q8Y0Z0 | Q9Y617 |
| 1656 | REQHIRRDKATSNIC | Bacillus subtilis, Bacillus cereus, Bacillus thuringiensis, Bacillus cereus, Bacillus cereus, Bacillus cereus, Bacillus cereus, Bacillus cereus, Bacillus cereus, Bacillus cereus, Bacillus cereus, Bacillus cereus, Bacillus thuringiensis, Bacillus anthracis, Bacillus anthracis, Bacillus anthracis, Bacillus weihenstephanensis, Bacillus cytotoxicus, Bacillus licheniformis, Bacillus methylotrophicus, Bacillus pumilus, Listeria innocua, Listeria monocytogenes, Listeria monocytogenes, Listeria monocytogenes, Listeria welshimeri, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, | P54376, Q730W2, Q6HDT7, Q818M4, B7HB99, B7IXL3, B9IXL8, B7HNZ0, Q634V7, C1ERU9, B7JMV0, A0RIL0, Q81M07, C3LKQ3, C3P8D4, A9VH11, A7GSN7, Q65HG0, A7Z6M3, A8FF40, Q92C05, Q71ZX3, C1L2Q5, B8DFX9, Q8Y7D4, A0AIF0, B9DNN6, Q6GGG3, P64218, P64217, A5IT64, A6U207, A7X250, Q5HFM3, Q8NWC9, Q2FY34, Q2FGI6, Q6G930, Q49XY0, Q4L6N6, Q5HP13, Q8CMM0 | P23378 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Staphylococcus aureus, Staphylococcus aureus, Staphylococcus aureus, Staphylococcus saprophyticus, Staphylococcus haemolyticus, Staphylococcus epidermidis, Staphylococcus epidermidis* | | |
| 1657 | RERIPERVVHA | *Streptomyces venezuelae, Streptomyces coelicolor* | P33569, Q9Z598 | P04040 |
| 1658 | RERIPERVVHAKG | *Rhizobium meliloti* | P95631 | P04040 |
| 1659 | RERIPERVVHAKGAGA | *Lactobacillus sakei* | P30265 | P04040 |
| 1660 | RETDTMDTFV | *Geobacter sulfurreducens, Geobacter metallireducens, Geobacter uraniireducens, Geobacter sp., Geobacter bemidjiensis, Geobacter daltonii* | Q74AZ0, Q39T99, A5G677, C6E100, B5EE39, B9M9F3 | O15031 |
| 1661 | RETDTMDTFVDS | *Rhizobium etli, Rhizobium sp., Rhizobium leguminosarum, Rhizobium etli, Rhizobium leguminosarum, Rhizobium meliloti, Rhizobium loti* | Q2K257, C3MB60, Q1MA25, B3P546, B5ZV40, Q92KW8, Q98EU7 | Q15031 |
| 1662 | REVDALDGL | *Methylobacterium sp., Methylobacterium radiotolerans, Methylobacterium populi* | B0UJI8, B1M186, B1ZGG2 | Q9Y2Z2 |
| 1663 | RFAPSPTGFLH | *Aeromonas hydrophila, Aeromonas salmonicida, Methylobacterium sp., Methylobacterium populi, Methylobacterium extorquens* | A0KNT0, A4SJD4, B0UQ09, B1Z9T1, A9W910 | Q5JPH6 |
| 1664 | RGANLSGGQ | *Haemophilus influenzae* | P71355 | O15440 |
| 1665 | RGERAYDIYSRLL | *Lactobacillus fermentum, Lactobacillus casei, Lactobacillus casei, Bacillus methylotrophicus, Lactobacillus plantarum, Bacillus subtilis, Bacillus licheniformis, Lactobacillus johnsonii, Lactobacillus gasseri, Lactobacillus delbrueckii, Lactobacillus delbrueckii, Bacillus cereus, Bacillus thuringiensis, Bacillus cereus, Bacillus cereus, Lactobacillus acidophilus, Bacillus pumilus, Bacillus anthracis, Lactobacillus helveticus, Bacillus halodurans, Lactobacillus sakei, Lactobacillus reuteri, Lactobacillus reuteri, Lactobacillus brevis, Bacillus clausii, Enterococcus faecalis, Listeria innocua, Listeria monocytogenes, Listeria monocytogenes, Pediococcus ntosaceus, Pseudomonas putida, Pseudomonas putida, Pseudomonas putida, Pseudomonas putida, Pseudomonas entomophila, Pseudomonas syringae, Pseudomonas syringae, Pseudomonas savastanoi, Pseudomonas fluorescens, Pseudomonas fluorescens, Pseudomonas fluorescens, Pseudomonas mendocina, Pseudomonas aeruginosa, Staphylococcus saprophyticus, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus,* | B2GAL4, B3WCR2, Q03AL0, A7Z939, Q88YH9, P80244, Q65EI5, Q74K84, Q042E8, Q1GB31, Q04BH7, Q631K2, Q6HBD8, Q815J6, Q72XW9, Q5FL55, A8FHN9, Q81X63, A8YUD9, Q9K709, Q38Y96, B2G613, A5VI14, Q03SM3, Q5WDK0, Q837R0, Q928C4, Q9RQI6, Q71WV9, Q03GX1, Q88KJ0, A5W635, B1J692, B0KJG6, Q1ICA8, Q4ZVM7, Q87YR6, Q48KZ0, Q3K9W9, Q4K9J6, C3JYK0, A4XTZ5, Q9I2U1, Q49VZ2, Q4L4J5, P63785, P99089, P63786, A8Z045, Q6GB62, Q6GIM3, Q2G036, A6QF76, Q5HHQ0, Q2YSF8, A5IQX2, A7WZR9, Q2F1M5, A6TZP7, B9DJL4, Q5HQW0, Q8CTE0, B2FQR2 | Q16740 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus aureus, Staphylococcus aureus, Staphylococcus aureus, Staphylococcus aureus, Staphylococcus aureus, Staphylococcus carnosus, Staphylococcus epidermidis, Staphylococcus epidermidis, Stenotrophomonas maltophilia | | |
| 1666 | RGFAVKFYT | Pseudomonas putida | P95539 | P04040 |
| 1667 | RGITIQSAAT | Bifidobacterium adolescentis, Leuconostoc citreum, Leuconostoc mesenteroides, Stenotrophomonas maltophilia, Stenotrophomonas maltophilia | A1A0T0, B1MW21, Q03ZQ2, B2FQ42, B4SKW0 | O96RP9 |
| 1668 | RGKGLMIGIE | Bacillus cereus | Q818W2 | Q9BYV1 |
|

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1681 | RIIVEKPFG | Staphylococcus epidermidis, Staphylococcus saprophyticus Haemophilus influenzae | P44311 | P11413 |
| 1682 | RI LLDAPCS | Pseudomonas aeruginosa, Pseudomonas syringae, Pseudomonas putida | Q9I7A9, Q88641, Q88RR3 | Q8TEA1 |
| 1683 | RIRFTSPHP | Arcobacter butzleri | A8ERE9 | Q965Z6 |
| 1684 | RKICAIGVR | Bacteroides thetaiotaomicron, Bacteroides fragilis, Bacteroides fragilis | Q8A858, Q64UP8, Q5LDM3 | A6NK58 |
| 1685 | RKLALKYHPD | Campylobacter hominis, Clostridium kluyveri | A7I2G3, A5N6M3 | Q8WW22 |
| 1686 | RLAIARALL | Escherichia coli | P23886 | Q2M3G0 |
| 1687 | RLDILVNNAG | Pseudomonas aeruginosa | Q9RPT1 | P15428 |
| 1688 | RLEFLGDAIL | Pseudomonas aeruginosa, Pseudomonas aeruginosa, Pseudomonas aeruginosa, Pseudomonas aeruginosa, Pseudomonas entomophila, Pseudomonas putida, Pseudomonas putida, Pseudomonas putida, Pseudomonas fluorescens, Pseudomonas putida, Pseudomonas syringae, Pseudomonas syringae, Pseudomonas savastanoi, Pseudomonas mendocina, Pseudomonas fluorescens, Pseudomonas fluorescens | A6VAK6, Q9XCX9, Q02HS2, B7UYX2, Q1I5V8, B0KV27, Q88MY5, A5W8F2, Q4KHT1, B1J4E0, Q87XG1, Q4ZPE1, Q48EV3, A4XSC4, C3K6Y7, Q3KHL9 | Q9UPY3 |
| 1689 | RLEFLGDAILD | Bacteroides vulgatus, Bacteroides fragilis, Bacteroides fragilis | A6KZ76, Q5LIS2, Q64ZV9 | Q9UPY3 |
| 1690 | RLEYRGYDSAG | Corynebacterium glutamicum | Q8NND3 | Q06210 |
| 1691 | RLEYRGYDSAGV | Corynebacterium diphtheriae, Corynebacterium efficiens, Pseudomonas aeruginosa | Q6NG33, Q8FNH2, Q9HT25 | Q06210 |
| 1692 | RLGFEGGQTP | Bacillus cereus, Bacillus weihenstephanensis, Bacillus thuringiensis, Bacillus cereus, Bacillus cereus, Bacillus cereus, Bacillus anthracis, Bacillus thuringiensis, Bacillus cereus, Bacillus cereus, Bacillus anthracis, Bacillus anthracis, Bacillus cereus, Bacillus cereus, Bacillus cereus, Bacillus cytotoxicus, Enterococcus faecalis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus gordonii, Streptococcus equi, Streptococcus equi, Streptococcus equi, Streptococcus sanguinis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus agalactiae, Streptococcus agalactiae, | B7IT38, A9VP96, Q6HPN9, B9IZL3, Q63H71, B7JKD8, C3LJA1, A0R8J9, B7HQW3, C1ET58, Q81VR1, C3P9S4, Q73F77, Q81J23, B7HJ67, A7GK39, Q839E5, B5XJ55, P0DE07, Q48VT0, Q1J8Z4, A2RC33, Q1JNZ8, Q1JE40, Q1JJ43, Q7CNP1, P0DE06, Q5XEB6, Q9A1V5, A8AZK6, C0ME24, B4U519, C0MBW6, A3CK83, C1CIB6, C1CPA7, C1CC25, B2IS59, Q8CVVV0, Q97SU3, B8ZKP9, B1I8L7, C1CAN1, B5E6H4, Q04ML7, Q8E2B5, Q3K3V0, Q8E752, B9DSW9 | Q9P015 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1693 | RLKTGTPPR | Streptococcus agalactiae, Streptococcus uberis Haemophilus ducreyi | Q7VPP9 | Q9Y2Z2 |
| 1694 | RLKTGTPPRI | Aeromonas salmonicida, Aeromonas hydrophila, Citrobacter koseri, Enterobacter sp., Haemophilus influenzae, Haemophilus influenzae, Haemophilus influenzae, Haemophilus somnus, Haemophilus influenzae, Klebsiella pneumoniae | A4STQ4, A0KQY9, A8ACP7, A4WGE6, P44763, Q4QMT9, A5UHB8, Q0I5W4, A5U9Q7, A6TG45 | Q9Y2Z2 |
| 1695 | RLLYVSCNP | Pseudomonas syringae | Q885Y8 | Q8IZ69 |
| 1696 | RLVLEVAQHLGE | Rhizobium meliloti, Rhizobium sp., Rhizobium leguminosarum, Rhizobium etli, Rhizobium leguminosarum, Rhizobium etli, Sphingomonas wittichii | Q92LK8, C3M9S1, Q1MAZ2, B3PQ68, B5ZSN7, Q2K3H0, A5V3X5 | P06576 |
| 1697 | RMTGGGFGGC | Haemophilus influenzae, Haemophilus influenzae, Haemophilus influenzae, Haemophilus parasuis | P31767, A5UDQ5, A5UHX0, B8F7C7 | P51570 |
| 1698 | RNIGIMAHIDAGKTTT | Porphyromonas gingivalis, Porphyromonas gingivalis | Q7MTL1, B2RLZ4 | Q969S9 |
| 1699 | RNIGIMAHIDAGKTTTTER | Micrococcus luteus | P09952 | Q969S9 |
| 1700 | RNIGIMAHIDAGKTTTTERIL | Bacillus clausii, Bacillus halodurans, Bifidobacterium longum, Bifidobacterium longum, Bifidobacterium animalis, Clostridium cellulolyticum, Desulfovibrio vulgaris, Desulfovibrio vulgaris | Q5WLR5, Q9Z9L7, Q8G5B6, B3DT30, B8DTV6, B8I5N7, A1VEB9, Q72CI3 | Q969S9 |
| 1701 | RNIGIMAHIDAGKTTTTERILYY | Desulfovibrio vulgaris, Pediococcus ntosaceus, Staphylococcus haemolyticus, Staphylococcus intermedius, Staphylococcus Scarnosus, Staphylococcus epidermidis, Staphylococcus epidermidis, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | B8DN94, Q03EB4, Q4L3K8, Q5U859, B9DKV7, Q8CQ82, Q5HRK5, Q49V57, A6QEJ9, P68791, P68790, Q6GBU0, Q6GJC1, P68789, P68788, Q5HIC8, Q2YSB4, A5IQA1, Q2G0N1, Q2FJ93, A6TZ24, A7WYX4 | Q969S9 |
| 1702 | RNIGISAHID | Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas hydrophila, Citrobacter koseri, Edwardsiella ictaluri, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, | B0VTG3, B0V8Y3, A3M306, B2HUQ4, B7I7S1, B7GYM8, Q6FDS6, A0KQ96, A8AQM8, C5BGM8, B7LS46, Q1R5U3, B6I240, B1LHE0, P0A6M8, B1IPV9, P0A6M9, Q0TCB9, A1AGM7, A8A5E7, C4ZUJ5, B1X6J0, B7M1P1, B7UK50, B7N0X6, B7NLP5, B5YTP7, P0A6N0, B7L4L1, B7MCV5, A7ZSL5, B7NDU8, P43925, A5U9R0, Q4QMT6, Q0I537, Q7VNA2, B8F7Z4, B4EYV7, Q8XV10, Q8XRM7 | Q96RP9 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Haemophilus influenzae, Haemophilus influenzae, Haemophilus somnus, Haemophilus ducreyi, Haemophilus parasuis, Proteus mirabilis, Ralstonia solanacearum, Ralstonia solanacearum | | |
| 1703 | RPRFGLLRGREF | Bacillus pumilus, Bacillus clausii, Bacillus licheniformis, Bacillus halodurans, Bacillus subtilis, Bacillus methylotrophicus, Bacillus cereus, Bacillus cereus, Bacillus cereus, Bacillus cereus, Bacillus weihenstephanensis, Bacillus cereus, Bacillus cereus, Bacillus anthracis, Bacillus anthracis, Bacillus anthracis, Bacillus thuringiensis, Bacillus thuringiensis, Bacillus cereus, Bacillus cereus, Bacillus cereus, Bacillus cytotoxicus, Lactobacillus gasseri, Lactobacillus johnsonii, Lactobacillus acidophilus, Lactobacillus helveticus, Campylobacter hominis, Listeria monocytogenes, Listeria monocytogenes, Listeria monocytogenes, Listeria welshimeri, Listeria innocua, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus haemolyticus, Staphylococcus saprophyticus | A8FDC1, Q5WFT6, Q65JJ1, Q9KA71, O31755, A7Z4S8, Q819Y4, B7HLF2, Q732Q0, B7HDU2, A9VT57, C1EP43, B7JJ97, C3L7A8, C3P5M1, Q81WL6, A0RHJ2, Q6HEZ6, Q636K7, B9IVA8, B7IUH7, A7GRE9, Q044C3, Q74IS2, Q5FJN0, A8YVR3, A7I1R8, B8DG08, Q720A3, C1L2M5, Q8Y7G2, A0AIC0, Q92C35, Q2YXK5, Q6GHH2, Q5HGG8, A8Z3U3, A6QGG3, Q2FHH5, Q2G1Z4, Q6G9V0, Q7A120, Q7A5Y3, Q99UK9, A7X1P3, A5ISE7, A6U182, Q8C5T7, Q5HPS8, Q4L5W5, Q49X48 | Q7L3T8 |
| 1704 | RPRGGDFLYS | Rhizobium loti | Q98L96 | Q9NTM9 |
| 1705 | RPWTIRQYAGFST | Porphyromonas gingivalis | Q59677 | P22033 |
| 1706 | RQPEFTQID | Clostridium tetani | Q892B2 | Q6PI48 |
| 1707 | RQTLLFSAT | Escherichia coli, Pseudomonas putida, Pseudomonas aeruginosa, Pseudomonas aeruginosa, Pseudomonas aeruginosa, Pseudomonas syringae | P21693, Q88NB7, Q9HXE5, B7UUT0, Q02S21, Q887N8 | Q9UJV9 |
| 1708 | RQTLLFSATMP | Lactobacillus reuteri, Listeria monocytogenes, Streptococcus pneumoniae, Streptococcus pneumoniae | Q9Z6C9, Q8Y8N0, P0A4D7, P0A4D8 | Q9UJV9 |
| 1709 | RRGRYVEFNL | Aeromonas salmonicida, Aeromonas hydrophila, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Klebsiella pneumoniae, Klebsiella pneumoniae, Proteus mirabilis, | A45T50, A0KEX7, A4WD41, B7M6U5, A7ZPN6, B1LMN0, B7N626, P36553, B1IWM6, A8A2T4, B1XAA7, C4ZX09, A1ADV0, Q8FFA3, Q0TF33, B7MY86, B7MHT7, B7UGD5, B7NPX2, B7LCI0, B7LKJ9, B5YZY1, Q8XBI4, B6IS12, B5XVR1, A6TC68, B4EZS7, Q3KKE0, B0KF35, A5WVK4, | P36551 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Pseudomonas fluorescens, Pseudomonas putida, Pseudomonas putida, Pseudomonas putida, Pseudomonas putida, Pseudomonas fluorescens, Pseudomonas aeruginosa, Pseudomonas savastanoi, Pseudomonas syringae, Pseudomonas aeruginosa, Pseudomonas aeruginosa, Pseudomonas aeruginosa, Pseudomonas entomophila, Pseudomonas syringae, Pseudomonas fluorescens, Pseudomonas mendocina, Ralstonia solanacearum, Ralstonia pickettii, Stenotrophomonas maltophilia, Stenotrophomonas maltophilia | Q88RQ6, B1J4A2, Q4KKQ4, A6UX86, Q480H6, Q500S4, B7VQ09, P43898, Q02V57, Q1I2G6, Q88649, C3K4I0, A4XNB8, Q8XXC3, B2U8Z4, B4SNL7, B2FND0 | |
| 1710 | RRGRYVEFNLLYDRGT | Rhizobium leguminosarum, Rhizobium etli, Rhizobium leguminosarum, Rhizobium meliloti, Rhizobium etli | B5ZY73, B3PV29, Q1MDJ5, Q92PD8, Q2K5S3 | P36551 |
| 1711 | RRLLYVSCNP | Pseudomonas syringae, Pseudomonas savastanoi | Q4ZQ44, Q48FH7 | Q8IZ69 |
| 1712 | RRLQVQERLT | Porphyromonas gingivalis, Porphyromonas gingivalis | Q7MWI5, B2RIJ1 | P30793 |
| 1713 | RRVLRPGGVL | Pseudomonas aeruginosa | A6UYW3 | Q6UX53 |
| 1714 | RRVVITGIG | Rhizobium leguminosarum, Rhizobium sp., Streptomyces rimosus | P04684, P72331, P43678 | Q9NWU1 |
| 1715 | RSAVSIARR | Bacillus subtilis | O31489 | Q8N5C6 |
| 1716 | RSPLWRGGG | Desulfovibrio salexigens | C6C186 | Q9BYD3 |
| 1717 | RTDAGVHAL | Akkermansia muciniphila, Lactobacillus reuteri, Lactobacillus reuteri, Lactobacillus fermentum, Bacillus sp., Lactobacillus brevis, Geobacter daltonii, Geobacter uraniireducens, Ralstonia pickettii, Ralstonia solanacearum | B2UNB6, B2G8U7, A5VLH4, B2GDT8, Q45557, Q03PY8, B9M6W5, A5GB00, B2U6Z1, Q8XXX8 | Q8N0Z8 |
| 1718 | RTNTCGELR | Porphyromonas gingivalis, Porphyromonas gingivalis | B2RHE0, Q7MXM0 | Q6PI48 |
| 1719 | RTSHYPYAEE | Escherichia coli | P05804 | P08236 |
| 1720 | RTTLLPGLL | Geobacter metallireducens, Geobacter sulfurreducens, Streptomyces avermitilis | Q39VS4, Q74CZ9, Q828C6 | Q9NSD9 |
| 1721 | RVALIGDAAH | Pseudomonas putida | Q53552 | Q9Y2Z9 |
| 1722 | RVDFNVPMK | Bacillus megaterium, Bacillus clausii, Bacillus licheniformis, Bacillus pumilus, Bacillus cereus, Bacillus cytotoxicus, Bacillus cereus, Bacillus subtilis, Bacillus cereus, Bacillus anthracis, Bacillus anthracis, Bacillus anthracis, Bacillus cereus, Bacillus cereus, Bacillus thuringiensis, Bacillus cereus, Bacillus thuringiensis, Bacillus cereus, Bacillus cereus, Bacillus weihenstephanensis, Bacillus halodurans, Listeria monocytogenes, Listeria monocytogenes, Listeria innocua, Listeria monocytogenes, Listeria monocytogenes, Listeria welshimeri | P24269, Q5WDK6, Q65EM9, A8FHJ3, P62409, A7GUS0, Q631L9, P40924, B7HW55, Q81X75, C3P0A6, C3LDI3, B9J4M7, B7JFG6, A0RKS6, C1EZA3, Q6HBF0, B7IP23, B7HED5, A9VQ51, Q9K714, Q8Y4I2, B8DD98, Q928I0, Q71WW8, C1KY97, A0ALE2 | P07205 |
| 1723 | RVEAFSDGV | Streptomyces collinus | S5VBU1 | Q9BSA9 |
| 1724 | RVEEMRQSL | Pseudomonas fluorescens | C3JY83 | O75306 |
| 1725 | RVGIGRPAH | Bacillus clausii | Q5WAD6 | Q86Y79 |
| 1726 | RVILQDFTGVP | Streptococcus mutans | Q59938 | P21399 |
| 1727 | RVILQDFTGVPAVVD | Bacillus subtilis, Staphylococcus epidermidis, Staphylococcus epidermidis, Staphylococcus aureus, Staphylococcus aureus, Staphylococcus aureus, Staphylococcus aureus, Staphylococcus aureus | P09339, Q8CPC2, Q5HPJ0, P63434, Q6G9K9, P99148, Q5HG69, P63433, Q6GH55 | P21399 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1728 | RVLRLPAVA | Haemophilus somnus, Neisseria meningitidis, Neisseria meningitidis, Neisseria gonorrhoeae | Q0I5H4, Q9JWC5, Q9JXK5, Q5F7J4 | O15067 |
| 1729 | RVRFAPSPTG | Bacillus clausii, Geobacter lovleyi, Porphyromonas gingivalis, Porphyromonas gingivalis, Uncultured termite | Q5WLT5, B3E399, B2RI67, Q7MUF7, B1H0J3 | Q5JPH6 |
| 1730 | RVRIALALKG | Pseudomonas aeruginosa | P57109 | O43708 |
| 1731 | RVTVLGHVQRGG | ptoclostridium difficile, Listeria welshimeri, Listeria monocytogenes, Listeria monocytogenes, Listeria monocytogenes, Listeria innocua | Q180P4, A0AJ20, Q8Y6W0, Q71Z96, C1KVL8, B8DHH7, Q92BE4 | P17858 |
| 1732 | RVVDASIMP | Klebsiella pneumoniae | B5Y008 | Q8NE62 |
| 1733 | RYCINSAAL | Lactobacillus salivarius, Bacillus methylotrophicus, Bacillus subtilis, Helicobacter pylori, Helicobacter pylori, Ralstonia solanacearum, Streptococcus pyogenes, Streptococcus pyogenes, Streptococcus pyogenes, Streptococcus equi, Streptococcus pyogenes, Streptococcus pyogenes, Streptococcus equi, Streptococcus agalactiae, Streptococcus agalactiae, Streptococcus agalactiae, Streptococcus gordonii | Q1WVT3, A7Z5S1, P54155, Q9ZMK8, O25011, Q8XYL1, Q99ZV6, P0DC42, P0DC43, C0MDV8, Q8P172, Q5XCD0, C0M8H8, Q8E026, Q3K1F5, Q8E5Q9, Q9LAM9 | Q8IXL7 |
| 1734 | RYLGDLSGGQV | Corynebacterium diphtheriae | P71119 | P09601 |
| 1735 | RYRQRYLDLI | Arcobacter butzleri, Bacillus halodurans, Bacillus clausii, Bacillus subtilis, Bacillus weihenstephanensis, Bacillus cereus, Bacillus cereus, Bacillus thuringiensis, Bacillus cereus, Bacillus anthracis, Bacillus thuringiensis, Bacillus cereus, Bacillus cereus, Bacillus cereus, Bacillus cereus, Bacillus cytotoxicus, Citrobacter koseri, Enterobacter sp., Enterococcus faecalis, Escherichia coli, Escherichia coli, Escherichia coli, Escherichia coli, Escherichia coli, Escherichia coli, Haemophilus ducreyi, Haemophilus influenzae, Haemophilus influenzae, Haemophilus influenzae, Haemophilus influenzae, Helicobacter pylori, Helicobacter pylori, Helicobacter pylori, Helicobacter pylori, Helicobacter acinonychis, Helicobacter pylori, Helicobacter pylori, Listeria innocua, Listeria monocytogenes, Listeria monocytogenes, Listeria welshimeri, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Staphylococcus aureus, Staphylococcus aureus | A8ESJ5, Q9KGG4, Q5WLU5, P37477, A9VN90, B7ISY7, B7JK84, Q6HPU0, Q63HC2, Q81VW3, A0R8E9, Q81J70, B7HJ16, B7HPY8, Q73FD1, A7GJY9, A8AP96, A4WE42, Q839A8, P0A8N6, P0A8N5, Q8FAT5, P0A8N4, P0A8N3, Q8XD57, Q7VLU5, A5UIX4, Q4QL88, A5UCQ0, P43825, P56126, B2USI3, B6JPT1, B5Z9V6, Q17YS1, Q1CUX6, Q9ZMP8, Q92F47, Q8YAB8, Q724I4, A0AF28, Q8CQV5, Q5HRN7, Q4L3H5, Q53638, Q6GJF4, P67609, P67610, Q5HIF7, Q2YVW8, Q2FJC3, Q2G0Q3, A7WYS8, Q49V26, Q8NXZ0, Q6GBX1 | Q15046 |
| 1736 | SAHGTNPASA | Bacillus halodurans, Bacillus clausii, Bacillus cereus, Bacillus methylotrophicus, Bacillus cytotoxicus, Bacillus thuringiensis, | Q9K936, Q5WF32, P62029, A7Z6M2, A7GSN6, A0RIK9, Q634V8, Q6HDT8, | P23378 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Bacillus cereus, Bacillus thuringiensis, Bacillus cereus, Bacillus anthracis, Bacillus anthracis, Bacillus anthracis, Bacillus cereus, Bacillus cereus, Bacillus cereus, Bacillus cereus, Bacillus weihenstephanensis, Bacillus cereus, Bacillus subtilis, Bacillus cereus, Bacillus licheniformis, Listeria welshimeri, Listeria monocytogenes, Listeria monocytogenes, Listeria monocytogenes, Listeria monocytogenes, Listeria innocua, Staphylococcus saprophyticus, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | C1ERU8, Q81M08, C3P8D3, C3LKQ2, B7JMU9, B7HNY9, B9IXL7, B7IXL2, A9VH10, B7HB98, P54377, Q818M5, Q65HG1, A0AIF1, Q8Y7D3, B8DFX8, Q71ZX2, C1L2Q6, Q92C04, Q49XX9, Q4L6N5, Q2YSZ4, Q8NWD0, A8Z474, Q6G931, Q2FY35, Q2FGI7, P99168, P64219, A5IT63, A7X2R9, A6U206, Q6GGG4, A6QH79, Q5HFM4, Q8CMM1, Q5HP14 | |
| 1737 | SCNIFSTQDH | Desulfovibrio alaskensis, Desulfovibrio vulgaris, Desulfovibrio vulgaris, Desulfovibrio vulgaris, Desulfovibrio salexigens, Geobacter sulfurreducens, Rhizobium loti | Q30WL8, A1VFZ7, Q72EH1, B8DR41, C6C1F4, P61617, Q98CM3 | P23526 |
| 1738 | SCTTNCLAPLAKVI | Enterobacter aerogenes | P24163 | O14556 |
| 1739 | SDAFFPFRD | Aeromonas salmonicida, Aeromonas hydrophila, Citrobacter koseri, Clostridium perfringens, Clostridium perfringens, Clostridium perfringens, Clostridium botulinum, Clostridium botulinum, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter sulfurreducens, Geobacter metallireducens, Geobacter uraniireducens, Geobacter sp., Geobacter bemidjiensis, Geobacter lovleyi, Geobacter daltonii, Haemophilus somnus, Haemophilus influenzae, Klebsiella pneumoniae, Klebsiella pneumoniae, Neisseria gonorrhoeae, Neisseria gonorrhoeae, Neisseria meningitidis, Neisseria meningitidis, Proteus mirabilis, Pseudomonas stutzeri, Pseudomonas syringae, Pseudomonas fluorescens, Pseudomonas mendocina, Pseudomonas aeruginosa, Pseudomonas aeruginosa, Pseudomonas aeruginosa, Pseudomonas putida, Pseudomonas aeruginosa, Pseudomonas | A45R98, A0KGJ2, A8AKS0, Q0SV48, Q0TTB0, Q8XMK2, B2V3C3, B2TN76, B7NRT9, B1XC09, P15639, B1IUP1, C5A0U7, B7LAV3, B7LUJ6, B7NFU7, B7MRD0, Q0TA59, B5Z0A3, Q8X611, B1LPG6, Q1R5X1, B7MIZ2, A1AIH7, B6I5L8, B7M7R5, A7ZUM3, A8A7A6, Q8FB68, B7UPG1, Q74FJ9, Q39RK1, A5G879, C6E5Z3, B5EBF9, B3E7F6, B9M4Q6, Q0I557, P43852, B5XYD2, A6TGR3, B4RP71, Q5F6T1, A9M4I2, Q9JZM7, B4EYT2, A4VPK9, Q87VR9, C3K6E0, A4XQ60, Q9HUV9, B7V1R6, A6VCVV0, B1J5T3, Q02FG6, Q4KIX5, Q1I4C1, A5W9K7, Q88DK3, B0KJZ6, Q8Y232, B2UFL5 | P31939 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | fluorescens, Pseudomonas entomophila, Pseudomonas putida, Pseudomonas putida, Pseudomonas putida, Ralstonia solanacearum, Ralstonia pickettii | | |
| 1740 | SDAYSTGSS | Campylobacter concisus, Campylobactercurvus | A7ZC90, A7GXA8 | P04424 |
| 1741 | SDELNHASIIDGIRL | Bacillus methylotrophicus, Bacillus subtilis, Bacillus pumilus | A7Z4X1, O31777, A8FDG9 | O75600 |
| 1742 | SDELNHASL | Corynebacterium kropnstedtii | C4LK80 | O15270 |
| 1743 | SDGIMVARGDLG | Methylobacterium extorquens | O05118 | P30613 |
| 1744 | SDHIETLYE | Geobacter bemidjiensis, Geobacter sp., Geobacter daltonii, Geobacter uraniireducens | B5EJ44, C6E7U2, B9M326, A5GDG7 | P22830 |
| 1745 | SDVANAVLDGAD | Corynebacterium glutamicum | Q46078 | P30613 |
| 1746 | SEDMLGRVF | Clostridium novyi | A0PZC7 | P15313 |
| 1747 | SEKETGDRN | Clostridium perfringens | Q8XIW8 | Q9UI32 |
| 1748 | SERIRTYNF | Bacillus halodurans, Bacillus clausii, Streptococcus pyogenes, Streptococcus pyogenes, Streptococcus pyogenes, Streptococcus pyogenes, Streptococcus pyogenes, Streptococcus mutans, Streptococcus thermophilus, Streptococcus thermophilus, Streptococcus thermophilus, Streptococcus pyogenes, Streptococcus agalactiae, Streptococcus pyogenes, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus sanguinis, Streptococcus gordonii, Streptococcus pyogenes | Q9K6F4, Q5WB55, P0DD95, P0DD94, B5XLI8, Q48TL0, Q99ZP5, Q8DU64, Q03L79, Q5M0B7, Q5M4W4, Q5XC69, Q3K1I9, A2REH9, Q1J6M1, Q1JGV2, Q1JLQ2, Q1JBR9, Q8DZM4, Q8E5C3, A3CN05, P47850, Q8P125 | O75570 |
| 1749 | SEVMLQQTQVATVI | Escherichia coli, Haemophilus influenzae | P17802, P44320 | Q9UIF7 |
| 1750 | SFHSLEDRI | Geobacter daltonii | B9M164 | A6NJ78 |
| 1751 | SFHSLEDRIVK | Geobacter sulfurreducens, Geobacter metallireducens, Geobacter uraniireducens, Geobacter sp., Geobacter bemidjiensis, Pseudomonas mendocina, Pseudomonas aeruginosa, Pseudomonas aeruginosa, Pseudomonas aeruginosa, Pseudomonas aeruginosa, Pseudomonas entomophila, Pseudomonas putida, Pseudomonas putida, Pseudomonas putida, Pseudomonas putida | P60396, Q39YM7, A5G8K8, C6DZJ8, B5EBP3, A4XQR6, Q02H20, Q9HVZ5, B7UZJ8, A6VB93, Q1I5130, B0KFT4, A5W8Q8, Q88N84, B1J1Y2 | A6NJ78 |
| 1752 | SFITPVPGGVGPMT | Campylobacter hominis, Campylobacter curvus | A7I254, A7GXK2 | P11586 |
| 1753 | SFTGSTQVG | Pseudomonas putida | P43503 | P49419 |
| 1754 | SFTKGCYIGQE | Haemophilus influenzae | P44000 | Q5T440 |
| 1755 | SGAGGQHVN | Lactobacillus reuteri, Lactobacillus casei, Lactobacillus casei, Pseudomonas fluorescens, Pseudomonas savastanoi, Pseudomonas syringae, Pseudomonas aeruginosa, Pseudomonas aeruginosa, Pseudomonas aeruginosa, Pseudomonas fluorescens, Pseudomonas aeruginosa, Stenotrophomonas maltophilia, Stenotrophomonas maltophilia | B2G676, B3WDK7, Q03A29, Q4K695, Q48MV4, Q4ZXW7, P42806, B7V0L1, Q02G09, C3KDC6, A6VC61, B4SKS8, B2FQ14 | Q9UGC7 |
| 1756 | SGAGGQHVNTTDSA | Citrobacter koseri, Edwardsiella ictaluri, Enterobacter sp., Escherichia | A8AG02, C5B814, A4WBC6, B7UQ99, | Q9UGC7 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Proteus mirabilis, Pseudomonas mendocina, Pseudomonas fluorescens | B7LSH9, B619S6, B1LH89, Q1RCM7, B1IU82, B7N422, P0A7I0, A1AAD8, P0A7I1, A7ZZE7, Q0TIF9, P0A7I2, B1XAQ2, C4ZTQ2, B7LXC6, B5YXM9, B7NUX7, A7ZKY5, B7LGX2, B7MKB3, B7MTZ5, A6TAN9, B4EVR7, A4XR61, Q3K6W9 | |
| 1757 | SGAGGQHVNTTDSAVRI | Geobacter lovleyi, Geobacter uraniireducens, Staphylococcus haemolyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus | B3E628, A5G8T7, Q4L7Z9, Q5HMA4, Q8CNI7, Q6GEV7, Q2YUN5, A8YY83, P66020, Q6G7J2, P66019, P66018, A6QIW2, Q5HE82, Q2FF10, A5IUR3, Q2FWE0, A6U3K3, A7X4W4, Q49Z65 | Q9UGC7 |
| 1758 | SGAGKSSLI | Acinetobacter baylyi | Q6FAN3 | Q6NXR0 |
| 1759 | SGAGKSSLL | Escherichia coli, Escherichia coli, Escherichia coli, Pseudomonas entomophila, Pseudomonas putida | P0AAF7, P0AAF6, P0AAF8, Q1IGN4, Q88RB3 | Q8N139 |
| 1760 | SGAGKSTLLN | Haemophilus ducreyi | Q7VP69 | Q94911 |
| 1761 | SGAGKSTLM | Fusobacterium nucleatum | Q8REG7 | P45844 |
| 1762 | SGAHLNPAV | Pseudomonas aeruginosa | Q51389 | P29972 |
| 1763 | SGAHLNPAVT | Escherichia coli, Escherichia coli, Escherichia coli, Haemophilus influenzae, Streptomyces coelicolor | P0AER0, P0AER1, P0AER2, P44826, P19255 | P29972 |
| 1764 | SGDLAPLSH | Streptomyces avermitilis, Streptomyces griseus, Streptomyces coelicolor | Q82I33, P24221, Q9EWW1 | P42357 |
| 1765 | SGEPMDKAG | Clostridium perfringens, Clostridium perfringens, Clostridium perfringens, Neisseria meningitidis, Neisseria meningitidis | Q0SR36, Q0TNG7, Q8XIH4, Q9K0J8, Q9JVK3 | O95671 |
| 1766 | SGFPKNRVIG | Bacillus clausii, Bacillus halodurans, Fusobacterium nucleatum | Q5WEG2, Q9K849, Q8RED8 | P00338 |
| 1767 | SGGGSGHEPAH | Citrobacter freundii | P45510 | Q3LXA3 |
| 1768 | SGGPNSVYA | Streptococcus equi, Streptococcus pyogenes, Streptococcus pyogenes, Streptococcus pyogenes, Streptococcus pyogenes, Streptococcus pyogenes, Streptococcus pyogenes, Streptococcus equi, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus agalactiae, Streptococcus uberis | C0MAM2, P64299, B5XLN9, Q1J6G5, P64300, Q48TF6, Q1JGP6, Q5XC20, C0MFC7, P0DB55, P0DB54, Q1JBM8, Q1JLL1, A2RED2, Q8DZX7, Q8E5M8, Q3K1C0, B9DUB2 | P49915 |
| 1769 | SGGPNSVYAEDA | Streptococcus thermophilus, Streptococcus thermophilus | Q5M4P4, Q5M029 | P49915 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1770 | SGGQKQRIA | Leuconostoc mesenteroides | Q10418 | Q9NRK6 |
| 1771 | SGGQKQRISLAR | Escherichia coli | Q9X2W0 | Q96J66 |
| 1772 | SGHKIYGPKG | Edwardsiella ictaluri | C5BEU5 | Q9Y697 |
| 1773 | SGHWEHYQEDMF | Streptococcus uberis, Streptococcus sanguinis, Streptococcus equi | B9DU13, A3CP56, C0MCN7 | Q9BW92 |
| 1774 | SGIGRAVSV | Bacillus subtilis, Bacillus subtilis | P80873, P40397 | Q92506 |
| 1775 | SGILVQLPLP | Helicobacter pylori | Q9ZLQ4 | Q9H903 |
| 1776 | SGKGGVGKS | Bacillus subtilis, Escherichia coli, Escherichia coli, Haemophilus influenzae, Helicobacter pylori | P40742, P0AF09, P0AF08, P45135, O25678 | P53384 |
| 1777 | SGKGGVGKST | Bacillus subtilis, Clostridium perfringens, Helicobacter pylori, Helicobacter pylori, Helicobacter pylori, Helicobacter pylori, Pseudomonas fragi | P50863, P53381, O24999, Q9ZMM5, O25098, Q9ZMA8, P72190 | P53384 |
| 1778 | SGLRGRGGAGFPTG | Desulfovibrio fructosivorans, Streptomyces coelicolor | Q46507, Q9XAQ9 | P49821 |
| 1779 | SGLRGRGGAGFPTGLKWSFM | Rhizobium meliloti | P56912 | P49821 |
| 1780 | SGLRLGTPA | Staphylococcus carnosus, Stenotrophomonas maltophilia, Stenotrophomonas maltophilia | B9DMF3, B4SJB0, B2FNK2 | P34896 |
| 1781 | SGLRLGTPALT | Campylobacter jejuni, Campylobacter jejuni, Campylobacter jejuni, Campylobacter jejuni, Campylobacter jejuni | A7H4X6, Q5HW65, A8FKI9, P24531, A1VYC2 | P34896 |
| 1782 | SGPLVRSSY | Corynebacterium urealyticum, Corynebacterium jeikeium, Corynebacterium aurimucosum, Corynebacterium efficiens, Streptomyces coelicolor | B1VHG8, Q4JWE0, C3PHK6, Q8FNP4, Q9S2P2 | O43766 |
| 1783 | SGPSGAGKST | Fusobacterium nucleatum | Q8RHI9 | Q16774 |
| 1784 | SGPSGAGKSTLLK | Campylobacter jejuni, Campylobacter jejuni | Q5HTT7, Q9PNB8 | Q16774 |
| 1785 | SGSGKTTLL | Bacillus subtilis, Bacillus subtilis, Bacillus halodurans, Haemophilus influenzae, Pseudomonas fluorescens, Rhizobium meliloti, Rhizobium loti, Rhizobium meliloti | O34697, P42423, Q9K619, Q57213, Q3KCC5, Q92VJ2, Q98K23, Q92XW1 | Q9H222 |
| 1786 | SGTDGVGTK | Finegoldia magna | B0S0R2 | P22102 |
| 1787 | SGTDGVGTKL | Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas hydrophila, Aeromonas salmonicida, Lactobacillus delbrueckii, Lactobacillus delbrueckii, Lactobacillus salivarius, Bacillus halodurans, Lactobacillus acidophilus, Bacillus clausii, Lactobacillus helveticus, Lactobacillus fermentum, Bacillus thuringiensis, Bacillus thuringiensis, Bacillus cereus, Bacillus cereus, Bacillus anthracis, Bacillus anthracis, Bacillus anthracis, Bacillus weihenstephanensis, Bacillus cereus, Bacillus cereus, Bacillus cytotoxicus, Bacillus cereus, Bacillus cereus, Bacillus cereus, Bacillus cereus, Bacillus cereus, Lactobacillus reuteri, Lactobacillus reuteri, Bifidobacterium longum, Bifidobacterium longum, Bifidobacterium longum, Bifidobacterium adolescentis, Bifidobacterium animalis, Clostridium botulinum, Clostridium acetobutylicum, Clostridium botulinum, Clostridium botulinum, Clostridium botulinum, Clostridium | B0VT70, B2HWV2, A3M7X8, B0VDJ1, B7GY98, B7I5C6, Q6F973, A0KM24, A4SL28, Q1G9G0, Q049L9, Q1WU57, Q9KF55, Q5FIV3, Q5WJ84, A8YW83, B2GF76, Q6HPA2, A0R8Z8, C1EV65, B7JM87, Q81ZH0, C3L534, C3PBN2, A9VRF3, B9J1K7, Q73EN3, A7GKI0, B7HS34, B7IUV5, Q63GT1, B7H4T8, Q81IQ1, A5VHU0, B2G5C0, B3DT56, Q8G595, B7GU81, A1A0R8, B8DTT6, C3L2V1, Q97J93, A7GH98, B1IL59, C1FV78, A7FXD5, B1KZ57, C5BHQ4, A4WD72, Q833Z1, B7LKE3, B6I571, Q1R8N9, B7MHY0, B7MYC7, Q8XAC5, B5Z036, B1IWG1, A8A2Z1, Q8FF72, B7M7K3, B7N681, B1LNF0, B7LCN9, | P22102 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *botulinum, Clostridium botulinum, Edwardsiella ictaluri, Enterobacter sp., Enterococcus faecalis, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Haemophilus influenzae, Haemophilus influenzae, Haemophilus somnus, Haemophilus parasuis, Klebsiella pneumoniae, Klebsiella pneumoniae, Listeria welshimeri, Listeria monocytogenes, Listeria monocytogenes, Listeria monocytogenes, Listeria innocua, Listeria monocytogenes, Proteus mirabilis, Pseudomonas mendocina, Pseudomonas savastanoi, Pseudomonas fluorescens, Pseudomonas putida, Pseudomonas putida, Pseudomonas putida, Pseudomonas syringae, Pseudomonas syringae, Pseudomonas putida, Pseudomonas fluorescens, Pseudomonas entomophila, Pseudomonas fluorescens, Pseudomonas aeruginosa, Pseudomonas aeruginosa, Streptococcus suis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pyogenes, Streptococcus agalactiae, Streptococcus pneumoniae, Streptococcus pneumoniae, Streptococcus pneumoniae, Streptococcus agalactiae, Streptococcus pyogenes, Streptococcus agalactiae, Streptococcus pyogenes, Streptococcus pyogenes, Streptococcus pyogenes, Streptococcus pyogenes, Streptococcus pyogenes, Streptococcus pneumoniae, Streptococcus pyogenes, Streptococcus pyogenes, Streptococcus pyogenes, Streptococcus gordonii, Streptococcus sanguinis, Streptococcus uberis, Streptococcus pyogenes, Streptococcus mutans, Streptococcus thermophilus, Streptococcus thermophilus, Streptococcus thermophilus* | Q0TEY9, P08178, C4ZX74, B1XAX4, A7ZPU2, B7UGN7, B7NQN8, A5UC39, A5UEU3, P43848, Q4QKF3, Q0I5D1, B8F5E6, A6TCB3, B5XNQ0, A0AJM1, Q71YQ1, C1KW66, B8DDZ0, Q92AP1, Q8Y6C3, B4EY89, A4XWN5, Q48FI4, Q4K8A5, B0KT52, A5W7R7, Q88MA9, Q4ZQ51, Q885Y1, B1J1M3, C3K102, Q1IDL2, Q3KFT0, Q9I513, B7UXY9, Q02IA6, Q9F1T6, C1CNS6, B2IR37, Q97TA2, C1CBM4, B8ZJN0, C1C9V1, B1I7V5, Q9A1Z0, Q8E7W9, Q8DRM4, Q04N22, C1CHV9, Q8E2G1, A2RBZ5, Q3K400, Q5XEF4, Q1J936, Q8P312, B5XJ18, P0DD63, P0DD62, B5E5J6, Q1JJ82, Q1JE80, Q48VX3, A8AU99, A3CJZ4, B9DSR4, Q1JP36, Q8DWL1, Q5M203, Q5M6J5, Q03MZ8 | |
| 1788 | SGTDGVGTKLK | *Bacillus subtilis, Bacillus pumilus, Bacillus methylotrophicus, Bacillus* | P12043, A8FAM9, A7Z251, Q65MS6, | P22102 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | licheniformis, Desulfitobacterium hafniense, Desulfitobacterium hafniense, Clostridium phytofermentans, Geobacter lovleyi, Geobacter bemidjiensis, Geobacter sp., Neisseria meningitidis, Neisseria meningitidis, Neisseria meningitidis, Neisseria gonorrhoeae, Neisseria meningitidis, Ralstonia solanacearum, Staphylococcus saprophyticus, Staphylococcus haemolyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus carnosus, Stenotrophomonas maltophilia, Stenotrophomonas maltophilia | B8FP03, Q24QH4, A9KHX3, B3E3K3, B5EFU7, C6E6M9, Q9JUA2, A9LZD2, A1KU60, Q5F973, Q9JZ80, Q8XW52, Q49WJ5, Q4L580, Q5HQ99, Q8CT29, Q2YX52, Q5HH13, A8Z1L3, Q2FI07, Q2FZI8, A6QFS9, A6U0N9, P67721, P99163, A5IRV8, A7X0W4, Q8NX90, Q6GAE2, Q6GI13, B9DQ40, B45N29, B2FRX8 | |
| 1789 | SGTDGVGTKLKIA | Clostridium kluyveri, Clostridium kluyveri, Clostridium cellulolyticum, Clostridium novyi, Clostridium thermocellum, Geobacter sulfurreducens, Geobacter daltonii, Geobacter uraniireducens, Geobacter metallireducens | B9E4K8, A5N0Q2, B8I492, A0Q1J2, A3DEV1, Q74CB6, B9M1P4, A5G3H3, Q39UK1 | P22102 |
| 1790 | SGVGKSSLV | Bacteroides thetaiotaomicron | Q8A8H7 | Q5HYI8 |
| 1791 | SGWDFSSRW | Citrobacter koseri, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli | A8AFT6, Q0TIH3, B7UQ86, B1LHA4, B7NUW3, B619Q8, P13482, B1IU96, A7ZZD1, B1XAN8, C4ZTN8, B7N408, Q8CVV46, B7LGV7, Q1RCP3, B7MK99, A7ZKW9, A1AAC5, Q8XDH7, B7LXB1 | O43280 |
| 1792 | SIPVIANGDI | Escherichia coli, Escherichia coli, Escherichia coli, Klebsiella pneumoniae | P0ABT5, P0ABT6, P0ABT7, O52536 | O95620 |
| 1793 | SIRDVIAFPK | Bifidobacterium longum, Bifidobacterium longum, Bifidobacterium longum | Q8G863, B7GPT0, B3DPM0 | Q6PI48 |
| 1794 | SIWAPSQTL | Bacillus subtilis, Bacillus halodurans | P18185, Q9K8V7 | P27708 |
| 1795 | SKAGVIGLT | Clostridium scindens | P07914 | Q92506 |
| 1796 | SKKARDGKL | Escherichia coli | P06959 | O00330 |
| 1797 | SKPGEPSWP | Edwardsiella ictaluri | C5B8V6 | P49589 |
| 1798 | SKPLKGARI | Bacteroides fragilis, Bacteroides thetaiotaomicron | Q64MT2, Q8A407 | P23526 |
| 1799 | SLKKLQLDY | Escherichia coli, Escherichia coli | Q46857, Q8XBT6 | P17516 |
| 1800 | SLLGGGGVDG | Citrobacter koseri, Klebsiella variicola, Klebsiella pneumoniae | A8AI35, D3RKJ0, B5XXK9 | Q9BQ69 |
| 1801 | SLNVSVAAG | Acinetobacter baylyi | Q6FF50 | Q6IN84 |
| 1802 | SLPNSRIMIHQP | Helicobacter hepaticus | Q7VIN7 | Q16740 |
| 1803 | SLWPMTFGLACCA | Bacillus weihenstephanensis, Bacillus thuringiensis, Bacillus cereus, Bacillus thuringiensis, Bacillus cereus, Bacillus anthracis, Bacillus cereus, Bacillus anthracis, Bacillus cereus, Bacillus cereus, Bacillus cereus, Bacillus anthracis, Bacillus cereus, Bacillus | A9VS97, Q6HAY6, Q630U9, A0RL90, B9IRT1, Q81K01, Q814W7, C3P1E8, C1F0M2, B7HY57, B7HFJ5, C3LFH3, Q72XF4, B7JGM4, | O75251 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | cereus, Bacillus cereus, Bacillus cytotoxicus, Desulfovibrio vulgaris | B7IQV2, A7GV50, B8DS03 | |
| 1804 | SLWPMTFGLACCAVEMMH | Ralstonia solanacearum, Ralstonia pickettii | Q8XXQ2, B2U7R0 | O75251 |
| 1805 | SMCEHHLVPF | Bacillus methylotrophicus, Bacillus pumilus, Bacillus subtilis, Bacillus cytotoxicus, Bacillus weihenstephanensis, Bacillus cereus, Bacillus thuringiensis, Bacillus cereus, Bacillus cereus, Bacillus cereus, Bacillus cereus, Bacillus cereus, Bacillus cereus, Bacillus cereus, Bacillus cereus, Bacillus anthracis, Bacillus anthracis, Bacillus anthracis, Bacillus thuringiensis, Clostridium perfringens, Clostridium perfringens, Clostridium perfringens, Corynebacterium glutamicum, Corynebacterium glutamicum, Listeria monocytogenes, Listeria monocytogenes, Listeria monocytogenes, Listeria innocua, Listeria monocytogenes, Listeria welshimeri, Streptococcus thermophilus, Streptococcus thermophilus, Streptococcus agalactiae, Streptococcus agalactiae, Streptococcus agalactiae, Streptococcus suis, Streptococcus suis, Streptococcus mutans | A7Z630, A8FEL2, P19465, A7GN48, A9VMC0, B9IVN3, Q6HL44, Q63DM1, Q81FQ8, C1EN08, B7HL21, Q73AY4, B7HHR5, B7IP89, B7JGZ6, Q81SW2, C3L8S8, C3P598, A0RBW5, Q8XLM2, Q0STY9, Q0TRM0, Q8NM84, A4QH94, Q71Y82, C1KWN3, Q8Y5X1, Q92A75, B8DBZ3, A0AK45, Q5LYM8, Q5M391, Q8DZI5, Q3K0Y1, Q8E549, A4W1S9, A4WH1, Q8DUG2 | P30793 |
| 1806 | SMRIMTRMG | Corynebacterium diphtheriae, Corynebacterium kropnstedtii, Corynebacterium efficiens, Corynebacterium jeikeium, Corynebacterium glutamicum, Corynebacterium glutamicum | Q6NET5, C4LGT5, Q8FM16, Q4JY04, A4QHQ4, Q9AEM1 | P35558 |
| 1807 | SNASCTTNC | Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus | Q8CNY0, Q5HNL7, Q6GG19, Q6G8N9, P64181, P99067, P64180, Q5HF86 | O14556 |
| 1808 | SNASDALDK | Desulfovibrio vulgaris, Desulfovibrio alaskensis, Streptomyces coelicolor | Q728G0, Q313E8, P58481 | P14625 |
| 1809 | SNHGGRQLD | Pseudomonas putida | P20932 | Q9NYQ3 |
| 1810 | SNPVDILTY | Corynebacterium glutamicum, Corynebacterium glutamicum, Corynebacterium diphtheriae, Listeria innocua, Listeria monocytogenes, Listeria monocytogenes | Q8NLN0, A4QHW5, P62050, Q92F65, Q724K3, P33380 | Q9BYZ2 |
| 1811 | SPAEKAGLQ | Haemophilus influenzae | P44936 | Q5T2W1 |
| 1812 | SPCGACRQV | Bacillus subtilis | P19079 | P32320 |
| 1813 | SPDKDVDGFH | Neisseria meningitidis, Neisseria meningitidis, Neisseria meningitidis, Neisseria gonorrhoeae, Neisseria gonorrhoeae | P0C277, Q9JWI9, A9M068, A1KWF4, B4RQN5, Q5F5D0 | P13995 |
| 1814 | SPNGKLRLL | Geobacter lovleyi, Geobacter metallireducens, Geobacter uraniireducens | B3E2M3, Q39UC4, A5G439 | P09467 |
| 1815 | SPRFRGEHALRRYP | Methylobacterium sp., Methylobacterium nodulans, Rhizobium meliloti, Rhizobium loti | B0ULL2, B8IUV4, Q92QP4, Q98KR4 | O00217 |
| 1816 | SPRQSDVMI | Rhizobium etli, Rhizobium etli, Rhizobium meliloti | B3PY57, Q2K3U4, P56897 | O75251 |
| 1817 | SQGRLESLLN | Pseudomonas savastanoi, Pseudomonas syringae, Pseudomonas syringae | Q48ME3, Q4ZXH2, Q887L5 | P23378 |
| 1818 | SQSGETADTL | Bacteroides thetaiotaomicron, Clostridium tetani, Geobacter sulfurreducens, Rhizobium loti, | Q8AAB1, Q890U2, Q74GH6, Q98LX5, P08633, Q92ZK3, | Q06210 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Rhizobium leguminosarum, Rhizobium meliloti, Rhizobium meliloti, Rhizobium meliloti | Q92P54, P25195 | |
| 1819 | SQSSNDTFPTAM | Campylobacter jejuni | O69294 | P07954 |
| 1820 | SQWGHDFRP | Bacillus subtilis | O34748 | P46063 |
| 1821 | SRHPFPGPGLAIR | Arcobacter butzleri | A8ETA7 | P49915 |
| 1822 | SRQRYWGTPIPI | Sphingomonas wittichii | A5VA89 | Q15031 |
| 1823 | SRTDAGVHAL | Bacillus cereus, Bacillus cereus, Bacillus anthracis, Bacillus thuringiensis, Bacillus cereus | Q63GF1, Q73E17, Q6I3T8, Q6HNW5, Q813Z9 | Q8N0Z8 |
| 1824 | SRTRVKTLA | Propionibacterium acnes | Q6AAI8 | P46926 |
| 1825 | SRVALVTGA | Streptomyces cinnamonensis | P41177 | O75828 |
| 1826 | SSGSACTSA | Acinetobacter baumannii, Acinetobacter baumannii, Acinetobacter baumannii, Acinetobacter baumannii, Acinetobacter baumannii | B0VD51, B7H3H0, B2HZI5, B715Q3, B0VNW2 | Q9Y697 |
| 1827 | SSGSACTSASLEPSYVLRA | Haemophilus parasuis, Haemophilus somnus,, Haemophilus influenzae, Haemophilus influenzae, Haemophilus influenzae, Neisseria meningitidis, Neisseria meningitidis, Neisseria meningitidis, Neisseria gonorrhoeae, Neisseria gonorrhoeae, Pseudomonas stutzeri, Pseudomonas aeruginosa, Pseudomonas aeruginosa, Pseudomonas aeruginosa, Pseudomonas mendocina, Pseudomonas aeruginosa, Pseudomonas fluorescens, Pseudomonas fluorescens, Pseudomonas fluorescens | B8F356, Q0I1L2, Q57337, A5UGI1, A5UAA8, A9M029, A1KUK1, Q9JTX0, B4RMB8, Q5F8X4, A4VNY2, B7UWH7, Q9HXI8, Q02RW8, A4XY43, A6V0U8, Q3K7A5, C3K1M5, Q4K6T8 | Q9Y697 |
| 1828 | SSGSACTSASLEPSYVLRAIG | Haemophilus ducreyi | Q7VMA9 | Q9Y697 |
| 1829 | SSPNTAGLR | Stenotrophomonas maltophilia, Stenotrophomonas maltophilia | B2FPI7, B4STK4 | Q02127 |
| 1830 | SSRTDAGVHA | Clostridium kluyveri, Clostridium beijerinckii | A5N4T0, A6LPU5 | Q8N0Z8 |
| 1831 | SSRTDAGVHAL | Clostridium tetani | Q890R5 | Q8N0Z8 |
| 1832 | STGGGASLE | Bifidobacterium longum, Bifidobacterium longum, Bifidobacterium longum, Corynebacterium jeikeium, Corynebacterium glutamicum, Corynebacterium glutamicum, Corynebacterium urealyticum, Corynebacterium aurimucosum, Corynebacterium efficiens, Micrococcus luteus | B7GQU7, B3DRV9, Q8G6D6, Q4JVJ3, A4QEG1, Q01655, B1VDQ4, C3PG40, Q8FT66, C5CBP5 | P07205 |
| 1833 | STGGGASLEL | Arcobacter butzleri, Campylobacter curvus, Campylobacter concisus, Campylobacter jejuni, Campylobacter jejuni, Campylobacter jejuni, Campylobacter jejuni, Campylobacter fetus, Campylobacter hominis, Campylobacter jejuni, Corynebacterium kropnstedtii | A8EWM4, A7GWT1, A7ZEZ5, Q5HT15, A8FN77, Q9PMQ5, A1W116, A0RQT4, A7I1G1, A7H5C5, C4LIR6 | P07205 |
| 1834 | STGGGASLELLEGK | Corynebacterium diphtheriae, Desulfovibrio desulfuricans | P62411, B8J4D3 | P07205 |
| 1835 | STGGGASLELLEGKILP | Helicobacter hepaticus, Helicobacter pylori, Helicobacter pylori | Q7VJB6, P56154, Q9ZJP1 | P07205 |
| 836 | STGVPHILEH | Clostridium perfringens | Q46205 | Q5JRX3 |
| 1837 | STNHKDIGTLYL | Rhizobium leguminosarum | Q08855 | P00395 |
| 1838 | SVAFDLATHRGYDSD | Rhizobium meliloti | O86028 | P22033 |
| 1839 | SVFAGVGERTREGND | Acinetobacter baylyi, Acinetobacter baumannii, Acinetobacter baumannii, Acinetobacter baumannii, Acinetobacter baumannii, Acinetobacter baumannii, Acinetobacter baumannii, Neisseria | Q6FFK0, A3M144, B0VNK4, B0VBP3, B7H294, B7I1W4, B2I102, A1KW11, A9M123, Q9JW70, Q9JXQ2, B2FHY8, | P06576 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | meningitidis, Neisseria meningitidis, Neisseria meningitidis, Stenotrophomonas maltophilia, Stenotrophomonas maltophilia | B4SJR9 | |
| 1840 | SVFAGVGERTREGNDL | Desulfitobacterium hafniense, Desulfitobacterium hafniense | Q24MP1, B8FZ34 | P06576 |
| 1841 | SVLEMSHRS | Streptococcus suis, Streptococcus suis, Streptococcus uberis, Streptococcus thermophilus, Streptococcus thermophilus, Streptococcus thermophilus | A4VU42, A4W0D4, B9DTW4, Q03JH6, Q5LYP0, Q5M3A4 | Q9Y617 |
| 1842 | SVLFVCLGNICRSP | Bacillus subtilis | Q35O16 | P24666 |
| 1843 | SVSDKTGLV | Lactobacillus casei, Lactobacillus casei, Leuconostoc citreum | B3WF93, Q037V3, B1MY42 | P31939 |
| 1844 | SVSDKTGLVE | Stenotrophomonas maltophilia, Stenotrophomonas maltophilia | B45L92, B2FJP9 | P31939 |
| 1845 | SVVGTSSLRR | Enterobacter sp., Klebsiella pneumoniae, Klebsiella pneumoniae, Proteus mirabilis, Proteus mirabilis, Pseudomonas entomophila, Pseudomonas fluorescens, Pseudomonas aeruginosa, Pseudomonas aeruginosa, Pseudomonas aeruginosa, Pseudomonas aeruginosa | A4WG12, A6TGI8, B5XYL1, B4F1X3, Q59684, Q1I316, Q4K3X3, Q02EA3, B7V5F0, Q60169, A6VE37 | P08397 |
| 1846 | SYAAVPLYR | Rhizobium etli, Rhizobium leguminosarum, Rhizobium leguminosarum, Rhizobium etli | Q2KBM0, B5ZSV4, Q1MKI3, B3PSB4 | Q9Y6N1 |
| 1847 | SYEARAFGV | Rhizobium loti, Rhizobium loti, Streptococcus pneumoniae, Streptococcus pneumoniae, Streptococcus pneumoniae | Q98NW7, Q98JM5, Q975C7, Q8DQZ7, Q04M21 | Q9Y253 |
| 1848 | TAARGRGKS | Citrobacter koseri, Escherichia coli | A8ADB3, P76562 | Q9H0A0 |
| 1849 | TAMTGDGVND | Streptococcus pneumoniae | P35597 | O14983 |
| 1850 | TAVLIETLV | Acinetobacter baylyi, Corynebacterium diphtheriae, Pseudomonas syringae, Pseudomonas fluorescens, Pseudomonas fluorescens, Pseudomonas putida, Pseudomonas savastanoi, Pseudomonas syringae, Pseudomonas entomophila, Pseudomonas putida, Pseudomonas putida, Pseudomonas fluorescens, Rhizobium leguminosarum, Rhizobium leguminosarum, Rhizobium etli, Rhizobium etli, Streptomyces atroolivaceus, Streptomyces avermitilis, Streptomyces griseus, Streptomyces coelicolor, Streptomyces argillaceus | Q6FA43, P61456, Q4ZZ92, Q4K4H7, Q3K5D7, B0KMQ0, Q48PB5, Q87V73, Q1I3W5, A5WA09, B1J2Y8, C3K3G6, B5ZV80, Q1MNC6, Q2KE72, B3PVW2, Q8GGL7, Q82DC9, B1VUW6, Q9KZM1, Q936D6 | P23526 |
| 1851 | TDGERILGLGD | Acinetobacter baylyi | Q6FFL8 | P48163 |
| 1852 | TDGVGTKLK | Desulfovibrio vulgaris, Desulfovibrio alaskensis | B8DNV5, Q311C7 | P22102 |
| 1853 | TDKTGTLTQ | Escherichia coli, Escherichia coli | P0ABB8, P0ABB9 | O43861 |
| 1854 | TDTVVISMGQ | Sphingomonas wittichii | A5V656 | P00480 |
| 1855 | TDTVVISMGQE | Campylobacter hominis | A7I3W8 | P00480 |
| 1856 | TDVTNASRT | Corynebacterium efficiens, Methylobacterium radiotolerans | Q8FLY8, B1LWN6 | Q14409 |
| 1857 | TDVTNASRTML | Streptomyces avermitilis, Streptomyces coelicolor | Q828K5, Q9ADA7 | Q14409 |
| 1858 | TDVTNASRTMLFNI | Parabacteroides distasonis | A6LCZ1 | Q14409 |
| 1859 | TDVTNASRTMLFNIH | Lactobacillus reuteri, Lactobacillus reuteri | B2G7U6, A5VKE8 | Q14409 |
| 1860 | TEGCRGEGG | Escherichia coli, Escherichia coli, Escherichia coli | P0AC41, P0AC42, P0AC43 | P31040 |
| 1861 | TEGCRGEGGIL | Escherichia coli, Haemophilus influenzae, Proteus vulgaris | P00363, P44894, P20922 | P31040 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1862 | TEPGAGSDV | Citrobacter koseri, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Proteus sp., Proteus mirabilis | A8ALR4, B7LWN0, Q1RGF9, B1LFX2, B6HYZ0, P60584, B7N7R4, A7ZVY9, A1A789, C4ZPW5, B1XBG4, B7NHE3, B7MNP6, B5YYD3, B7L4G2, B7UI85, P60586, B7MAG2, A7ZHD0, B7M0D6, Q0TLV0, Q8GB20, B4EY23 | P11310 |
| 1863 | TERVLYYTG | Rhizobium loti | Q98N59 | Q96RP9 |
| 1864 | TFDSGGISIK | Aeromonas hydrophila, Aeromonas salmonicida, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Klebsiella pneumoniae, Klebsiella pneumoniae, Proteus mirabilis | A0KPF3, A4SSA7, A8AMA5, A4WF25, B6I2H3, Q1R2Z4, B1LRE5, B7NGJ2, P68767, P68766, B1ISB1, A1AJG3, A8A816, Q0T9D1, B7M9L9, B1XEN9, C4ZRD1, B7NUH4, B7MSZ3, B7LCX0, B5Z3L7, B7MLR5, P68768, A7ZVE0, B7UQR7, B7LMT2, B5Y2T8, A6THI2, B4F2N1 | P28838 |
| 1865 | TFGCGSAIASSS | Klebsiella pneumoniae | P05343 | Q9H1K1 |
| 1866 | TFGFRGEAL | Clostridium novyi | A0QQM7 | P54278 |
| 1867 | TFGGNPMACA | Neisseria meningitidis, Neisseria meningitidis | Q9JTX9, Q9JYY4 | Q9BYV1 |
| 1868 | TFGLACCAVEMMH | Neisseria meningitidis, Neisseria meningitidis, Neisseria gonorrhoeae, Neisseria gonorrhoeae, Neisseria meningitidis | Q9K1C2, A1KRS3, B4RPI3, Q5F616, A1INN9 | O75251 |
| 1869 | TFGPTFRAE | Fusobacterium nucleatum, Clostridium kluyveri, Clostridium acetobutylicum | Q8RH70, A5N4F7, Q97E56 | Q96159 |
| 1870 | TFGPTFRAENS | Aeromonas hydrophila, Bacillus thuringiensis, Bacillus cereus, Bacillus anthracis, Bacillus cereus, Bacillus cytotoxicus, Bacillus cereus, Desulfitobacterium hafniense, Parabacteroides distasonis, Bacteroides fragilis, Bacteroides vulgatus, Bacteroides fragilis, Bacteroides thetaiotaomicron, Clostridium novyi, Clostridium thermocellum, Clostridium perfringens, Clostridium perfringens, Clostridium perfringens, Clostridium tetani, Clostridium botulinum, Clostridium botulinum, Clostridium botulinum, Clostridium botulinum, Clostridium botulinum, Clostridium beijerinckii, Desulfovibrio alaskensis, Desulfovibrio vulgaris, Desulfovibrio vulgaris, Escherichia coli, Escherichia coli, Escherichia coli, Escherichia coli, Escherichia coli, Escherichia coli, Escherichia coli, Escherichia coli, Geobacter sulfurreducens, Geobacter metallireducens, Geobacter uraniireducens, Haemophilus influenzae, Haemophilus influenzae, Haemophilus influenzae, Haemophilus somnus, Haemophilus parasuis, Klebsiella pneumoniae, Porphyromonas gingivalis, Porphyromonas gingivalis | A0KIC3, Q6HCVV9, Q633N6, Q81L32, Q72ZI3, A7GTK8, Q817I8, Q24MK1, A6LIA1, Q5L8W2, A6L0U5, Q64P24, Q8A0Z8, A0PY64, A3DBI2, Q0TMF3, P58693, Q0SQ51, Q899M9, A5HZE1, A7FRK8, B2UXS0, A7GB01, B2TI01, A6LPI6, Q317J6, Q72G53, A1V9B8, Q1RDS7, P0A8M0, B1IW01, P0A8M1, Q0TJC3, A7ZYN3, A7ZK21, P58694, Q74E08, Q39SY7, A5G5R2, A5UF16, A5UCB9, P43829, Q0I2M9, B8F3Y5, A6T726, Q7MVE5, B2RK42 | Q96159 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1871 | TFNDDIQGT | Bacillus subtilis | P45868 | P48163 |
| 1872 | TFNMDEYVG | Proteus mirabilis | B4ESJ0 | P46926 |
| 1873 | TFNMDEYVGL | Enterobacter sp., Haemophilus ducreyi, Porphyromonas gingivalis, Porphyromonas gingivalis | A4W844, Q7VKN1, B2RJ01, Q7MW43 | P46926 |
| 1874 | TFNMDEYVGLP | Aeromonas hydrophila, Aeromonas salmonicida, Parabacteroides distasonis, Bacteroides fragilis, Bacteroides fragilis, Bacteroides thetaiotaomicron, Bacteroides vulgatus, Citrobacter koseri, Desulfovibrio salexigens, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus somnus, Haemophilus parasuis, Klebsiella pneumoniae, Klebsiella pneumoniae | A0KIG3, A4SPM2, A6LHV2, Q64XP2, Q5LGU0, Q8A094, A6L7Q8, A8AJE0, C6C0A2, Q8FJX7, B7LKT5, Q1REP9, B1LLC0, B6HYN6, B7N9S4, P0A759, B1IY50, Q0TK13, A7ZXT7, A1A8T7, B1X6L1, B7M5J6, C4ZWF4, B7NMM9, B7MPI3, P0A760, B5YQM0, B7UKV0, B7L9L4, B7MFT4, A7ZJ60, Q0I4B9, B8F877, B5XZG9, A6T6C1 | P46926 |
| 1875 | TFVAELKGL | Haemophilus somnus, Haemophilus influenzae, Haemophilus influenzae, Haemophilus influenzae, Haemophilus influenzae | Q0I491, P44427, A5UCQ1, A5UIX3, Q4QL89 | P40926 |
| 1876 | TGAAQGIGR | Pseudomonas putida | P23102 | P15428 |
| 1877 | TGAGISTASG | Enterococcus faecalis | Q839C6 | Q8N6T7 |
| 1878 | TGARGLRSI | Lactobacillus reuteri, Lactobacillus plantarum, Lactobacillus salivarius, Lactobacillus brevis, Enterococcus faecalis, Leuconostoc mesenteroides, Pediococcus ntosaceus | A5VJ94, Q88VE2, Q1WU81, Q03QN7, Q833M7, Q03W09, Q03F27 | O76031 |
| 1879 | TGASSGIGE | Listeria innocua | Q92EK7 | Q9Y394 |
| 1880 | TGASSGIGEE | Staphylococcus saprophyticus | Q49WS9 | Q9Y394 |
| 1881 | TGEISPGMI | Desulfovibrio alaskensis | Q3QZW0 | P60174 |
| 1882 | TGGIASGKS | Streptococcus pyogenes, Streptococcus pyogenes, Streptococcus pyogenes, Streptococcus pyogenes, Streptococcus pyogenes, Streptococcus pyogenes, Streptococcus mutans | P58102, Q48UU5, P0DA44, Q5XDE3, P0DA45, P63834, Q8DSZ0 | Q8WVC6 |
| 1883 | TGHAEWRV | Ralstonia solanacearum | Q8Y1C6 | Q9UJ68 |
| 1884 | TGIKWDLL | Clostridium phytofermentans, Desulfovibrio vulgaris, Desulfovibrio vulgaris, Desulfovibrio vulgaris, Desulfovibrio alaskensis, Desulfovibrio desulfuricans | A9KK92, B8DRD2, Q72E04, A1VFJ5, Q313W0, B8J439 | P06576 |
| 1885 | TGIKVVDLLAPY | Arcobacter butzleri, Bacillus caldotenax, Bacillus halodurans, Bacillus cytotoxicus, Bacillus sp., Bacillus megaterium, Bacillus pseudofirmus, Bacillus cereus, Bacillus cereus, Bacillus cereus, Bacillus thuringiensis, Bacillus thuringiensis, Bacillus anthracis, Bacillus cereus, Bacillus cereus, Bacillus anthracis, Bacillus anthracis, Bacillus licheniformis, Bacillus cereus, Bacillus weihenstephanensis, Bacillus clausii, Bacillus cereus, Bacillus cereus, Bacillus cereus, Bacillus pumilus, Bacillus subtilis, ptoclostridium difficile, Clostridium beijerinckii | A8EV70, P41009, Q9K6H5, A7GV56, P07677, P12698, P22478, B9IRT7, B7HY64, Q72XE8, A0RL95, Q6HAY0, Q81JZ5, Q630U3, C1F0M8, C3LFH9, C3P1F4, Q65DX4, B7JGN0, Q5W378, Q814W2, B7HFK1, B7IQV8, A8FIB2, P37809, Q180W5, A6LQH6 | P06576<br><br>A9VSA3, |
| 1886 | TGIKVVDLLAPYA | Campylobacter jejuni, Campylobacter jejuni, Campylobacter jejuni, | Q0PC30, A1VXJ0, Q5HX59, A8FJR2, | P06576 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Campylobacter jejuni, Campylobacter concisus, Campylobacter jejuni, Campylobacter curvus, Campylobacter lari, Campylobacter fetus, Campylobacter hominis, Clostridium cellulolyticum | A7ZC37, A7H1I1, A7H0I7, B9KES3, A0RR26, A7I177, B8I579 | |
| 1887 | TGLSGAGKTT | Pseudomonas aeruginosa | P29811 | O43252 |
| 1888 | TGPCGPCSEI | Clostridium thermocellum | A3DKB6 | P49588 |
| 1889 | TGPNMGGKS | Neisseria gonorrhoeae, Neisseria meningitidis, Neisseria meningitidis, Neisseria gonorrhoeae, Neisseria meningitidis, Neisseria meningitidis, Rhizobium etli, Rhizobium leguminosarum, Rhizobium meliloti, Rhizobium loti | Q5F5J4, A9M4L8, A1KWM6, B4RPP9, Q9JWT7, Q9JX94, Q2KD76, Q1MMA5, P56883, Q98C21 | P20585 |
| 1890 | TGPNMGGKSTY | Haemophilus ducreyi | Q7VKA1 | P43246 |
| 1891 | TGPNMSGKSTY | Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae | C1CH06, C1CN23, B8ZPK0, C1CAQ5, Q04I96, P0A3R3, P0A3R4, B1I9E5 | O15457 |
| 1892 | TGQDGSYLAEFLLEKGYEVHGI | Escherichia coli, Escherichia coli, Escherichia coli | P0AC90, P0AC88, P0AC89 | O60547 |
| 1893 | TGRKIIVDTY | Lactobacillus casei, Lactobacillus casei, Clostridium botulinum, Clostridium botulinum, Clostridium novyi, Finegoldia magna, Leuconostoc mesenteroides, Leuconostoc citreum | B3WCC9, Q03AU4, B2UZL0, B2TK10, A0Q2Y4, B0S2I6, Q03VI4, B1N092 | Q00266 |
| 1894 | TGRTHQIRVH | Bacillus subtilis, Bacillus subtilis, Escherichia coli, Escherichia coli, Escherichia coli, Escherichia coli, Escherichia coli, Escherichia coli, Haemophilus ducreyi, Haemophilus influenzae, Haemophilus influenzae, Haemophilus ducreyi, Neisseria meningitidis, Neisseria meningitidis, Pseudomonas aeruginosa, Pseudomonas aeruginosa, Ralstonia solanacearum | Q45480, O31613, Q8X8J3, P0AA39, Q8FIP7, P65834, Q8X9F0, P33643, P59835, P44433, P44445, Q9L7A7, Q9JVB6, Q9K0B0, Q9HZM9, P33640, Q8XYX8 | Q8IZ73 |
| 1895 | TGRTHQIRVHL | Bacillus subtilis, Helicobacter pylori, Helicobacter pylori | P54604, Q9ZKP5, O25610 | Q8IZ73 |
| 1896 | TGSFKIRGA | Escherichia coli, Escherichia coli, Escherichia coli | P0AGF7, P0AGF6, P0AGF8 | Q9GZT4 |
| 1897 | TGSGKSSLL | Haemophilus influenzae | P45081 | Q96J66 |
| 1898 | TGSGKSTLL | Bacillus licheniformis | Q65P76 | P13569 |
| 1899 | TGTDEHGLK | Rhizobium loti | Q98MV8 | Q96GW9 |
| 1900 | TGTDEHGLKI | Lactobacillus plantarum | Q88Z97 | Q96GW9 |
| 1901 | TGTPWGGLT | Proteus mirabilis, Proteus mirabilis | B4F1A3, Q7X3P1 | P05089 |
| 1902 | THGSLEVGK | Pseudomonas fluorescens, Pseudomonas fluorescens | Q3KJE5, Q4KJN0 | Q96NU7 |
| 1903 | THIRLNIFPDGGIARLRV | Acinetobacter baumannii | B2I1L5 | Q8N6M5 |
| 1904 | THLGLPVFNTV | Escherichia coli, Escherichia coli, Escherichia coli, Haemophilus influenzae | P0AGF0, P0AGE9, P0AGF1, P45102 | P53597 |
| 1905 | THLGLPVFNTVKEA | Pseudomonas aeruginosa | Q51567 | P53597 |
| 1906 | TIAFGIRNV | Geobacter daltonii, Geobacter uraniireducens, Geobacter sulfurreducens | B9LZA9, A5GA37, Q74EU2 | Q5HYK3 |
| 1907 | TIGKGFQGV | Rhizobium loti | Q98N57 | P09001 |
| 1908 | TIIEPTSGNTGIGLA | Bacillus subtilis | P37887 | P35520 |
| 1909 | TIMENIRFG | Bacillus subtilis | O31708 | Q9NUT2 |
| 1910 | TIMGHVDHGKT | Campylobacter lari | B9KEV0 | P46199 |
| 1911 | TITMVGDLK | Parabacteroides distasonis | A6LA97 | P27708 |
| 1912 | TKDGVTVAK | Acinetobacter baylyi, Methylobacterium populi, | Q6F8P6, B1ZAU5, B1LVA0, B8DJC4, | P10809 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Methylobacterium radiotolerans, Desulfovibrio vulgaris, Geobacter uraniireducens, Geobacter sulfurreducens, Geobacter bemidjiensis, Geobacter sp., Geobacter daltonii, Geobacter metallireducens, Neisseria meningitidis, Neisseria meningitidis, Neisseria meningitidis, Neisseria meningitidis, Neisseria gonorrhoeae, Neisseria gonorrhoeae, Neisseria gonorrhoeae, Rhizobium loti, Rhizobium loti, Rhizobium sp., Rhizobium loti, Rhizobium loti, Rhizobium sp., Rhizobium meliloti, Rhizobium loti, Sphingomonas wittichii* | A5G9I2, Q747C7, B5E9Y2, C6DY43, B9LZ35, Q39ZP5, A9M0Q6, A1KW52, P57006, P42385, B4RRA1, Q5F541, P29842, Q981J9, Q98IH9, Q6W1D5, Q983S4, Q98AX9, Q6W163, Q92ZQ4, Q98IV5, A5VBQ6 | |
| 1913 | TKTRAEVRGGGRKP | *Corynebacterium efficiens* | Q8FS79 | Q9BYD3 |
| 1914 | TLAIIKPDA | *Haemophilus parasuis* | B8F3E4 | Q86XW9 |
| 1915 | TLAIIKPDAV | *Haemophilus somnus* | Q0I2G6 | Q86XW9 |
| 1916 | TLGGTCLNVGC | *Pseudomonas putida* | P31046 | P09622 |
| 1917 | TLLFANAGM | *Campylobacter jejuni* | A1VYL8 | P49588 |
| 1918 | TLLGQNVNS | *Clostridium botulinum, Clostridium botulinum, Clostridium botulinum, Clostridium botulinum, Clostridium botulinum, Clostridium tetani, Clostridium perfringens, Clostridium perfringens, Clostridium novyi, Clostridium perfringens, Clostridium acetobutylicum, Clostridium thermocellum, Clostridium botulinum, Clostridium botulinum, Finegoldia magna, Propionibacterium acnes* | B1IM69, A7GE46, B1KSA4, A5I2S3, A7FUL1, Q895H1, Q8XLE9, Q0TRE5, A000M5, Q0STS9, Q97I18, A3DDI9, B2V276, B2TIA8, B0S1C0, Q6A8Z7 | Q96SZ6 |
| 1919 | TLLGQNVNSF | *Desulfovibrio vulgaris, Desulfovibrio vulgaris* | A1VF04, Q72DE5 | Q96SZ6 |
| 1920 | TLNFGPQHP | *Clostridium beijerinckii* | A6LXQ2 | O75306 |
| 1921 | TLNFGPQHPAAHGVLRLV | *Ralstonia pickettii* | B2U7Q8 | O75306 |
| 1922 | TLVFDVELL | *Escherichia coli, Escherichia coli, Escherichia coli* | P65765, P65764, P45523 | P62942 |
| 1923 | TLVFEVELL | *Escherichia coli* | P0A9L3 | P26885 |
| 1924 | TLYHWDLPQ | *Bacillus circulans, Paenibacillus polymyxa, Bacillus subtilis* | Q03506, P22505, P42403 | Q9UEF7 |
| 1925 | TMLRVKDPK | *Pseudomonas aeruginosa* | Q9HU72 | Q04760 |
| 1926 | TMSTVGYGD | *Escherichia coli* | P31069 | Q12791 |
| 1927 | TMYGQMTAGS | *Bacillus clausii, Streptomyces coelicolor, Streptomyces avermitilis, Streptomyces griseus* | Q5WCP7, Q9KZ75, Q82HL2, B1VUR5 | Q96N76 |
| 1928 | TNAGKSTLFN | *Haemophilus somnus* | Q0I442 | Q8NC60 |
| 1929 | TNASRTMLF | *Clostridium phytofermentans* | A9KQC2 | Q14409 |
| 1930 | TNASRTMLFNIH | *Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Haemophilus influenzae, Haemophilus influenzae, Haemophilus influenzae, Haemophilus influenzae, Klebsiella pneumoniae, Klebsiella pneumoniae, Pseudomonas syringae, Pseudomonas syringae, Pseudomonas savastanoi* | A8AL00, A4WG72, B7NU81, B1LNM9, B7NFM3, P0A6F3, B1IVF3, Q0TAD8, A8A731, B1X1392, C5A093, P0A6F4, B5YZ64, B7MI58, B7LA23, A7ZUE0, B7LUS9, B7M6X7, B7UNP6, B7N2R7, P44400, A5UE44, A5UHH7, Q4QMM7, A6TFR2, B5XTD4, Q87XL0, Q4ZPI7, Q48F01 | Q14409 |
| 1931 | TNASRTMLFNIHSL | *Escherichia coli* | Q8FBC3 | Q14409 |
| 1932 | TNGSQFFITT | *Streptomyces anulatus* | Q06118 | P30414 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 1933 | TNGSQFFLT | Streptomyces anulatus | P77949 | Q9UNP9 |
| 1934 | TNPVDILTY | Bacillus methylotrophicus, Bacillus subtilis, Bacillus psychrosaccharolyticus, Bacillus psychrosaccharolyticus, Bacillus pumilus, Bacillus licheniformis, Corynebacterium efficiens | A7Z152, P13714, P14561, P20619, A8F9Q8, Q65NP0, Q8FLV6 | Q6ZMR3 |
| 1935 | TNVPGVFAAGD | Bacillus sp. | P26829 | Q96NN9 |
| 1936 | TPFYPRSPYG | Pseudomonas aeruginosa | Q51366 | O60547 |
| 1937 | TPGVAADLSHI | Proteus mirabilis | B4F2A1 | P40926 |
| 1938 | TPIINPPQSAILGMH | Escherichia coli, Escherichia coli, Haemophilus influenzae | P0AFG6, P0AFG7, P45302 | P36957 |
| 1939 | TPIPHNGCRP | Acinetobacter baumannii, Acinetobacter baumannii, Acinetobacter baumannii, Acinetobacter baumannii, Acinetobacter baumannii, Acinetobacter baumannii, Acinetobacter baylyi, Aeromonas salmonicida, Aeromonas hydrophila, Clostridium kluyveri, Clostridium kluyveri, Clostridium beijerinckii, Clostridium botulinum, Clostridium botulinum, Clostridium botulinum, Clostridium thermocellum, Enterobacter sp., Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter metallireducens, Haemophilus ducreyi, Haemophilus parasuis, Haemophilus somnus, Haemophilus influenzae, Haemophilus influenzae, Haemophilus influenzae, Klebsiella pneumoniae, Proteus mirabilis, Pseudomonas aeruginosa, Pseudomonas aeruginosa, Pseudomonas aeruginosa, Pseudomonas aeruginosa, Pseudomonas mendocina, Pseudomonas stutzeri, Pseudomonas putida, Pseudomonas putida, Pseudomonas putida, Pseudomonas entomophila, Pseudomonas putida, Pseudomonas syringae, Pseudomonas syringae, Pseudomonas fluorescens, Pseudomonas fluorescens, Pseudomonas savastanoi, Pseudomonas fluorescens, Stenotrophomonas maltophilia, Stenotrophomonas maltophilia | B2HZ85, B0V6U5, B0VQU1, B7IA16, A3M961, B7GW25, Q6F7T5, A4SSY3, A0KF43, A5N4S3, B9DYD5, A6LPT8, B1KSJ8, A7GJ47, C1FMS4, A3DJJ9, A4WFA5, B7LRR4, Q1R635, B1LHB1, B6I211, B7NDR9, P0A7R9, 611Q02, P0A7S0, Q0TCG4, A1AGI8, B7LHZ9, A8A5A2, B1X6E9, C4ZUF2, B7UK21, B7M103, B7N182, B7NLL7, B5YT16, P0A7S1, B7MCR3, A7ZSI6, Q39XY1, Q7VKF6, B8F6P8, Q0I139, A5UDS4, Q4QM99, P44379, A6TEV0, B4F1K7, B7V666, Q02T57, A6UZL1, Q9HWF8, A4XZ67, A4VHQ3, P59374, B1JAI9, A5VXS0, Q1IFU3, B0KK89, Q889U8, Q4ZMR6, Q3K610, C3K2V3, Q48D59, Q4K555, B2FQK6, B4SLH3 | P82912 |
| 1940 | TPIPHNGCRPRK | Methylobacterium sp., Methylobacterium nodulans, Rhizobium sp., Rhizobium meliloti, Rhizobium loti, Rhizobium etli, Rhizobium leguminosarum, Rhizobium leguminosarum, Rhizobium etli | B0UHU6, B8IT34, C3MB02, Q925W7, Q98N34, Q2K9J3, B5ZZ56, Q1M1B8, B3PWU4 | P82912 |
| 1941 | TPTPLGEGK | Propionibacterium acnes | Q6ABS5 | P11586 |
| 1942 | TPVFMPVGT | Acinetobacter baumannii, Acinetobacter baumannii, Acinetobacter baumannii, | A3M8S3, B0V625, B7I976, B7GWL4, B2HYN7, Q6FEJ4, | Q9BXR0 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Acinetobacter baumannii, Acinetobacter baumannii, Acinetobacter baylyi, Bacillus subtilis, Bacillus methylotrophicus, Bacillus licheniformis, Bacillus pumilus, Campylobacter concisus, Campylobacter jejuni, Campylobacter jejuni, Campylobacter jejuni, Campylobacter jejuni, Clostridium cellulolyticum, Neisseria meningitidis, Neisseria gonorrhoeae, Neisseria meningitidis, Neisseria gonorrhoeae, Neisseria meningitidis, Neisseria meningitidis | O32053, A7Z766, Q65GP9, A8FFQ9, A7ZD89, A1VZZ8, Q5HUF2, A8FM59, Q9PNT0, A7H331, B8I6M0, Q9JVA4, Q5F9U5, A1KSY1, B4RJY2, A9M374, Q9K096 | |
| 1943 | TPVFMPVGTQ | Arcobacter butzleri, Desulfovibrio maeticus, Helicobacter pylori, Helicobacter hepaticus | A8ERD1, C4XSI9, Q9ZMF4, Q7VHX2 | Q9BXR0 |
| 1944 | TPVFMPVGTQAT | Desulfitobacterium hafniense, Fusobacterium nucleatum | B8FQV2, Q8RDN0 | Q9BXR0 |
| 1945 | TPVPGGVGPMT | Arcobacter butzleri, Bacillus halodurans, Desulfovibrio maeticus, Desulfovibrio salexigens, Desulfovibrio vulgaris, Rhizobium sp. | A8ESH8, Q9K966, C4XLR8, C6BSL6, B8DMA9, Q6W210 | P13995 |
| 1946 | TQGKGLMPD | Haemophilus influenzae | P44557 | P11766 |
| 1947 | TQGKGLMPDGT | Escherichia coli, Escherichia coli, Escherichia coli, Escherichia coli, Escherichia coli, Escherichia coli, Escherichia coli, Escherichia coli, Escherichia coli, Escherichia coli, Escherichia coli | B1J085, A7ZX04, Q8X5J4, A7ZIA4, Q1RFI7, P25437, Q0TKS7, A1A835, Q8FKG1, B1LIP1 | P11766 |
| 1948 | TQIPILTMP | Enterococcus hirae, Enterococcus faecalis | Q08637, Q834X8 | P15313 |
| 1949 | TQKCIRAGGKHNDL | Akkermansia muciniphila | B2UKT4 | P49588 |
| 1950 | TQNVDALHT | Pseudomonas syringae | Q882K4 | Q9Y6E7 |
| 1951 | TRLTESGLS | Rhizobium meliloti, Rhizobium sp., Rhizobium loti, Sphingomonas wittichii | Q92QR8, C3MA28, Q982X5, A5VF68 | Q7KZN9 |
| 1952 | TRVGGIPEV | Bacillus anthracis | Q81ST7 | P37287 |
| 1953 | TSGATESNN | Pseudomonas syringae, Pseudomonas savastanoi, Pseudomonas syringae | Q4ZX34, Q48M05, Q887A1 | Q9Y697 |
| 1954 | TSGSTGKPK | Bacillus subtilis | O07619 | Q9NR19 |
| 1955 | TSGSTGKPKGV | Bacillus licheniformis | O68006 | Q9NR19 |
| 1956 | TSGSTGLPK | Escherichia coli | P37353 | O95573 |
| 1957 | TSGSTGRPKGVM | Escherichia coli, Escherichia coli | P11454, Q8XBV9 | O60488 |
| 1958 | TSGTTGFPK | Bacillus subtilis | O31826 | P0C7M7 |
| 1959 | TSGTTGLPK | Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q4L3Q0, Q9KWK5, Q5HIA1, Q7A1Q0, Q7A769, Q6GBR2, Q99W34, Q6GJ94, Q8CQ67, Q5HRH4 | Q9H6R3 |
| 1960 | TSGTTGLPKGV | Streptococcus agalactiae, Streptococcus agalactiae, Streptococcus agalactiae | Q8VM67, P59591, Q3JZ94 | Q9H6R3 |
| 1961 | TSGTTGNPK | Bacillus subtilis | P96575 | Q96GR2 |
| 1962 | TSVLKRAIRTL | Desulfovibrio alaskensis | Q30WZ8 | P15259 |
| 1963 | TTRSPREGEV | Bacillus subtilis | O34328 | Q96QZ7 |
| 1964 | TTTTHKTLRG | Lactobacillus salivarius, Eubacterium rectale, Methylobacterium radiotolerans, Streptococcus pneumoniae, Streptococcus pneumoniae, Streptococcus pneumoniae, Streptococcus pneumoniae, Streptococcus pneumoniae, Streptococcus pneumoniae, Streptococcus suis, | Q1WTR3, C4ZH69, B1LZ88, C1C6Z9, Q97R16, B1IB13, C1CRE4, Q8DPZ0, Q04KR0, C1CKA2, A4VUM9, A4W0W9, C1QE16, B2IPI0, B8ZPH5, B5E4E3 | P34897 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus suis, Streptococcus pneumoniae, Streptococcus pneumoniae, Streptococcus pneumoniae, Streptococcus pneumoniae* | | |
| 1965 | TTVVADTGD | *Aeromonas salmonicida, Edwardsiella ictaluri, Escherichia coli, Escherichia coli, Escherichia coli, Escherichia coli, Proteus mirabilis, Rhizobium etli, Rhizobium etli, Rhizobium leguminosarum* | A45K74, C5B7L0, Q8FLD1, K0BE10, P0A870, P0A871, B4F2V2, Q2K414, B3Q0T5, B5ZQY2 | P37837 |
| 1966 | TTVVADTGDF | *Pseudomonas fluorescens, Pseudomonas aeruginosa, Pseudomonas aeruginosa, Pseudomonas aeruginosa, Pseudomonas aeruginosa* | Q4KF90, B7UWP0, Q9I047, Q02NV3, A6V3U3 | P37837 |
| 1967 | TVIGGGDTA | *Campylobacter lari* | B9KFD9 | P07205 |
| 1968 | TVLIMELINN | *Fusobacterium nucleatum* | Q8RGE2 | P06576 |
| 1969 | TVPAYFNDA | *Bacillus methylotrophicus, Bacillus subtilis, Clostridium perfringens, Clostridium perfringens, Clostridium perfringens, Rhizobium leguminosarum, Staphylococcus haemolyticus, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | A7Z6W1, P17820, Q0SRE3, P26823, Q0TNS7, O33528, Q4L6T0, B9DNK0, A8Z4B9, P64408, Q5HFI0, Q6G8Y7, Q6GGC0, P99110, P64407, A6QHC3, Q2FXZ2, A5ITA8, A6U252, Q2FGE3, A7X2Y1, P45554, Q2YT47 | P11021 |
| 1970 | TVPAYFNDAQR | *Akkermansia muciniphila, Arcobacter butzleri, Campylobacter jejuni, Campylobacter jejuni, Campylobacter jejuni, Campylobacter lari, Campylobacter jejuni* | B2UKV6, A8EWT6, O69298, Q5HV33, A8FLH2, B9KCH0, A7H484 | P11021 |
| 1971 | TVPAYFNDAQRQATK | *Porphyromonas gingivalis, Porphyromonas gingivalis* | P0C937, B2RJ90 | P11021 |
| 1972 | TVPAYFNDAQRQATKDAG | *Acinetobacter baumannii, Acinetobacter baumannii, Acinetobacter baumannii, Acinetobacter baumannii, Acinetobacter baumannii, Acinetobacter baylyi, Aeromonas hydrophila, Aeromonas salmonicida, Aggregatibacter actinomycetemcomitans, Lactobacillus fermentum, Methylobacterium sp., Citrobacter koseri, Clostridium phytofermentans, Desulfovibrio maeticus, Desulfovibrio vulgaris, Desulfovibrio vulgaris, Desulfovibrio vulgaris, Desulfovibrio desulfuricans, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Haemophilus somnus, Haemophilus ducreyi, Klebsiella pneumoniae, Klebsiella pneumoniae, Methylobacterium nodulans, Methylobacterium extorquens,* | A3M8W9, B2HZZ7, B0V5U4, B7IBK5, B7H317, Q6F6N3, A0KMI6, A4SQ25, P71331, B2GBQ5, B0UR84, A8ALU3, A9KKU0, C4XQ63, B8DRD6, A1VFG6, Q72DW8, B8J402, C5B7L7, A4W6D5, A7ZW7, Q1RG18, P0A6Y8, B1IRG0, P0A6Y9, Q0TLX5, A1A766, P0A6Z0, A7ZHA4, Q0I3V2, P48209, A6T4F4, B5Y242, B8IHL3, B7KSZ4, A9W6R7, B1ZGR1, B1LZ51, B4F2V5, P42374, B3PXH3, Q2KDW6, Q1MN11, B5ZWQ2, A5V5P9 | P11021 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Methylobacterium extorquens, Methylobacterium populi, Methylobacterium radiotolerans, Proteus mirabilis, Rhizobium meliloti, Rhizobium etli, Rhizobium etli, Rhizobium leguminosarum, Rhizobium leguminosarum, Sphingomonas wittichii* | | |
| 1973 | TWRLNERHYG | *Lactobacillus johnsonii, Lactobacillus plantarum, Lactobacillus acidophilus, Lactobacillus plantarum, Lactobacillus johnsonii, Neisseria meningitidis, Neisseria gonorrhoeae, Neisseria gonorrhoeae, Neisseria meningitidis, Neisseria meningitidis, Neisseria meningitidis* | Q74LL9, Q88T35, Q5FMJ3, Q88YY8, Q74L45, A9M1A2, B4RIY7, Q5F7CQ3 Q9JYF7, A1KV25, Q9JTF2 | P15259 |
| 1974 | TYGCQMNVN | *Fusobacterium nucleatum* | Q8RG43 | Q96SZ6 |
| 1975 | TYGGNPLGC | *Pseudomonas putida* | P59319 | P04181 |
| 1976 | TYGTGCFLL | *Clostridium tetani* | Q893Q3 | Q14409 |
| 1977 | TYNKDLQEDKE | *Streptococcus suis, Streptococcus suis* | A4VXZ3, A4W487 | P04424 |
| 1978 | TYPLIGNYG | *Akkermansia muciniphila, Desulfovibrio vulgaris, Desulfovibrio desulfuricans* | B2URJ0, Q8KZA0, B8IZ56 | P27708 |
| 1979 | TYPLIGNYGI | *Bacillus halodurans, Bacillus cereus, Bacillus thuringiensis, Bacillus anthracis, Bacillus cereus, Bacillus cereus, Bacillus caldolyticus, Lactobacillus plantarum, Bacillus subtilis, Lactobacillus plantarum, Clostridium perfringens, Desulfovibrio salexigens, Staphylococcus epidermidis, Staphylococcus saprophyticus, Staphylococcus haemolyticus, Staphylococcus epidermidis, Staphylococcus aureus, Staphylococcus aureus, Staphylococcus aureus, Staphylococcus aureus, Staphylococcus aureus, Staphylococcus aureus, Streptococcus pyogenes, Streptococcus pyogenes, Streptococcus pyogenes, Streptococcus pyogenes, Streptococcus pyogenes, Streptococcus agalactiae, Streptococcus agalactiae* | Q9K8V6, Q819S2, Q6HES7, Q81WF1, Q636D9, Q732I2, P52557, P77885, P36838, O08317, Q8XHB2, C6C0A9, Q5HPY9, Q49WY3, Q4L5Q4, Q8CPJ5, P99147, P63730, Q5HGN0, P63729, Q6GA11, Q6GHN3, P0DA13, P63735, Q5XCR8, P0DA12, P58894, P63731, P63732 | P27708 |
| 1980 | VAAGGRYDGL | *Geobacter metallireducens, Geobacter sulfurreducens* | Q39UD2, P60915 | P12081 |
| 1981 | VAAGGRYDGLV | *Geobacter lovleyi* | B3EB83 | P12081 |
| 1982 | VAGETGSGK | *Escherichia coli* | P43329 | Q7Z478 |
| 1983 | VAGGMENMS | *Escherichia coli* | P76461 | Q9BWD1 |
| 1984 | VALLSGGGSGHEP | *Escherichia coli* | P76015 | Q3LXA3 |
| 1985 | VAMVGDGIND | *Escherichia coli, Escherichia coli, Haemophilus influenzae, Listeria monocytogenes* | Q8XD24, Q59385, P77868, Q60048 | Q04656 |
| 1986 | VAPGNAGTA | *Escherichia coli, Escherichia coli, Escherichia coli, Haemophilus influenzae, Neisseria meningitidis, Neisseria meningitidis* | P15640, Q8X612, Q8FB69, P43845, Q9JXA3, Q9JWU6 | P22102 |
| 1987 | VASEIMAVL | *Bacillus licheniformis, Eubacterium eligens* | Q65IA6, C4Z1V6 | P11586 |
| 1988 | VASYPFTTL | *Akkermansia muciniphila* | B2UQ30 | Q9H4K7 |
| 1989 | VATPVFMPVGTQ | *Helicobacter pylori, Helicobacter pylori, Helicobacter pylori, Helicobacter pylori, Helicobacter pylori* | B2USB2, O08314, B5ZA47, Q1CUM2, B6JKL0 | Q9BXR0 |
| 1990 | VAVYNHYKRI | *Kocuria rhizophila* | B2GGB7 | O76031 |
| 1991 | VDAIVNAAN | *Lactobacillus plantarum, Citrobacter rodentium, Pseudomonas aeruginosa,* | Q885K6, D2TT52, Q9HXU7, Q985D2, | A1Z1Q3 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Rhizobium loti, Streptococcus pyogenes, Streptococcus pyogenes, Streptococcus pyogenes, Streptococcus pyogenes, Streptococcus pyogenes | Q8P0X2, P0DC29, P0DC28, Q5XC09, Q99ZI6 | |
| 1992 | VDDLLATGGT | Desulfitobacterium hafniense, Desulfitobacterium hafniense, Clostridium thermocellum, Clostridium botulinum, Clostridium botulinum, Clostridium botulinum, Clostridium botulinum, Clostridium botulinum, Clostridium perfringens, Clostridium perfringens, Clostridium perfringens, Clostridium botulinum, Clostridium botulinum, Clostridium kluyveri, Clostridium kluyveri, Clostridium cellulolyticum, Clostridium acetobutylicum, Edwardsiella ictaluri, Finegoldia magna, Helicobacter pylori, Leuconostoc mesenteroides, Leuconostoc citreum, Proteus mirabilis, Streptococcus pneumoniae, Streptococcus suis, Streptococcus suis, Streptococcus sanguinis, Streptococcus gordonii, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus uberis, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus thermophilus, Streptococcus thermophilus, Streptococcus thermophilus, Streptococcus mutans | Q24UQ1, B8FQU0, A3DF48, A7GHS8, A7FY09, A5I6E1, B1IME3, B1L0A2, Q0TP22, Q8XJ22, Q0SRP2, B2TMZ9, B2V345, A5N1Z4, B9E5P8, B8I3F7, Q97GU0, C5BCZ7, B0S0M3, Q9ZLQ9, Q03W57, B1MZQ2, B4EU76, C1CSJ8, A4W292, A4VVY4, A3CNR3, A8AWY0, P63544, P63545, C1CLS6, B1ICZ7, B8ZLT9, C1C8G8, Q04JH1, B5E6M0, B9DUP2, A2REX9, P0CZ63, Q48TY5, B5XL39, Q1J702, P63546, Q1JM38, P0CZ62, Q1JC56, Q5XCH4, Q1JH84, P63548, Q03K92, Q5M3Y6, Q5LZD4, Q8DT95 | P07741 |
| 1993 | VDDLLATGGTM | ptoclostridium difficile | Q183I0 | P07741 |
| 1994 | VDDLLATGGTMN | Clostridium novyi | A0PZW4 | P07741 |
| 1995 | VDGKDVMPEVN | Haemophilus somnus | Q0I3C7 | P06744 |
| 1996 | VDILVNNAG | Escherichia coli, Escherichia coli, Streptomyces violaceoruber | P0AET8, P0AET9, P16542 | Q6IAN0 |
| 1997 | VDILVNNAGI | Escherichia coli, Rhizobium meliloti, Rhizobium meliloti | P76633, P06234, P50205 | Q6IAN0 |
| 1998 | VDKHSTGGVGD | Aeromonas hydrophila, Aeromonas salmonicida, Bacillus subtilis, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Klebsiella pneumoniae, Klebsiella pneumoniae, Proteus mirabilis, Rhizobium sp., Rhizobium meliloti, Staphylococcus epidermidis, Staphylococcus | A0KPE3, A4SRU3, P39142, A4W699, B7UR10, B1IS37, B6I6M9, B1LEI7, B7NH50, Q8FA52, B7LXU4, B7NW62, B5Z4R4, Q8X1335, A7ZVS5, A8A8B1, B7LEM8, P07650, B1XFJ2, B7MNI9, B7LNS2, B7MTC8, A6THZ7, B5Y276, B4EWA3, C3MBH0, Q92T50, Q5HM85, Q4L818, Q8CNH8, Q5HE64, Q2FWC1, | P19971 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | haemolyticus, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q2FEZ3, Q6GET9, Q6G7H4, Q8NVF6, Q7A4D0, Q99SC3, Q2YUL7 | |
| 1999 | VDPLDGTKE | Escherichia coli, Escherichia coli, Escherichia coli | Q8XCG6, Q8FAG5, P22255 | Q95861 |
| 2000 | VDQETGEDL | Methylobacterium extorquens, Methylobacterium extorquens | A9W8P8, B7KN55 | Q14562 |
| 2001 | VDQHAAHER | Rhizobium etli, Rhizobium meliloti, Rhizobium leguminosarum, Rhizobium leguminosarum, Rhizobium etli, Rhizobium loti, Rhizobium sp. | Q2KBX7, Q92RP4, B5ZSQ0, Q1MKU7, B3PRD9, Q983L2, C3MGW0 | Q9UHC1 |
| 2002 | VDTWWQTETGGI | Aeromonas hydrophila, Aeromonas salmonicida | A0KNI2, A4SJM6 | Q9NUB1 |
| 2003 | VDVLVNNAG | Streptomyces coelicolor | P16544 | Q9NYR8 |
| 2004 | VDVNVHPTK | Lactobacillus salivarius, Lactobacillus brevis, Lactobacillus plantarum, Clostridium acetobutylicum, Neisseria meningitidis, Neisseria meningitidis, Neisseria meningitidis, Neisseria gonorrhoeae, Neisseria gonorrhoeae, Neisseria meningitidis, Pediococcus ntosaceus | Q1WT16, Q03R34, Q88UZ8, Q97I20, Q9JT52, A1KUP6, A9M0G1, Q5F8M6, B4RLX4, Q9JYT2, Q03EQ8 | P40692 |
| 2005 | VDVNVHPTKHEV | Geobacter bemidjiensis, Geobacter sp., Geobacter sulfurreducens, Geobacter lovleyi, Geobacter daltonii, Geobacter uraniireducens | B5EGD4, C6E4L2, Q74BP0, B3E5Z2, B9M3N0, A5GEV5 | P40692 |
| 2006 | VEFSRNVLG | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | Q2FWD1, Q6GEU8, Q2YUM6, A8YY92, Q5HE73, Q6G7I3, A6Q1X1, P65923, A5IU52, P65924, A6U3L2, P99072, Q2FF01, A7X4X7 | P17812 |
| 2007 | VEGDSAFGFSGME | Oxalobacter formigenes | P40149 | Q9UJ83 |
| 2008 | VEIAGPGFIN | Geobacter sulfurreducens, Listeria welshimeri, Listeria monocytogenes, Listeria monocytogenes, Listeria monocytogenes, Listeria innocua, Listeria monocytogenes | Q74C63, A0ALP7, B8DBE8, Q71WL8, Q8Y493, Q927T2, C1KYX7 | P54136 |
| 2009 | VEIAGPGFINV | Desulfovibrio alaskensis | Q30Z04 | P54136 |
| 2010 | VELCGALKN | Lactobacillus delbrueckii | Q1G8H5 | Q8N335 |
| 2011 | VELNRKVLADLA | Desulfovibrio vulgaris, Desulfovibrio vulgaris | Q728R8, A1VBB7 | Q9BYC9 |
| 2012 | VEPIQGEAG | Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis, Staphylococcus carnosus | P60299, Q6GAW9, P60297, P60298, Q5HHC8, Q6GID1, Q8CT82, Q5HQK4, B9DIU0 | P04181 |
| 2013 | VEVGPRDGLQNEK | Pseudomonas aeruginosa | Q9I2A0 | Q8TB92 |
| 2014 | VEVNCETDFV | Clostridium kluyveri, Clostridium kluyveri, Clostridium tetani | A5N829, B9EI19, Q895L1 | P43897 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2015 | VFDLGGGTFD | Bacteroides vulgatus, Bacteroides fragilis, Bacteroides fragilis, Parabacteroides distasonis, Bacteroides thetaiotaomicron, Prevotella loescheii | A6L2X7, Q64X01, Q5LG30, A6LDG8, Q89YW6, Q93GF1 | P11021 |
| 2016 | VFTFGPTFRAE | Lactobacillus plantarum, Bacillus clausii, Enterococcus faecalis | Q88WA8, Q5WGB1, Q831X4 | Q96I59 |
| 2017 | VGAGSAGCVLA | Pseudomonas putida, Pseudomonas oleovorans | Q9WWW2, Q00593 | Q8NE62 |
| 2018 | VGASGDLAPL | Methylobacterium sp., Citrobacter koseri, Enterobacter sp., Klebsiella pneumoniae, Klebsiella pneumoniae, Methylobacterium nodulans, Pseudomonas syringae, Pseudomonas fluorescens, Pseudomonas fluorescens, Pseudomonas putida, Pseudomonas putida, Pseudomonas aeruginosa, Pseudomonas aeruginosa, Pseudomonas aeruginosa, Ralstonia solanacearum, Rhizobium meliloti | B0UQ15, A8AJ15, A4W8B5, B5XZ79, A6T6L1, B8II08, Q87UM1, Q3KJE6, Q8VMR3, P21310, Q88CZ7, Q02ER8, Q9HU85, B7V3J1, Q8XW29, O31197 | P42357 |
| 2019 | VGASGDLAPLSH | Rhizobium loti | Q983I0 | P42357 |
| 2020 | VGDEGGFAPN | Acinetobacter baylyi, Acinetobacter baumannii, Acinetobacter baumannii, Acinetobacter baumannii, Acinetobacter baumannii, Acinetobacter baumannii, Clostridium acetobutylicum | Q6FAT9, B0V677, B2I2A5, B71918, A3M5Y1, B7H227, B0VQI4, Q97L52 | P06733 |
| 2021 | VGDVRGKGL | Bacillus subtilis | P33189 | Q9BYV1 |
| 2022 | VGFPSVGKST | Streptococcus thermophilus, Streptococcus thermophilus, Streptococcus thermophilus | Q03JJ8, Q5M3C8, Q5LYR4 | Q9Y295 |
| 2023 | VGFPSVGKSTLLS | Bacillus halodurans, Bacillus licheniformis, Bacillus pumilus, Bacillus clausii, Lactobacillus sakei, Bacillus methylotrophicus, Bacillus weihenstephanensis, Bacillus cereus, Bacillus subtilis, Bacillus cereus, Bacillus thuringiensis, Bacillus cereus, Bacillus cereus, Bacillus thuringiensis, Bacillus cereus, Bacillus cereus, Bacillus cereus, Bacillus cereus, Bacillus anthracis, Bacillus cereus, Lactobacillus plantarum, Lactobacillus helveticus, Lactobacillus brevis, Lactobacillus gasseri, Lactobacillus acidophilus, Lactobacillus johnsonii, Lactobacillus salivarius, Lactobacillus casei, Lactobacillus casei, Enterococcus faecalis, Listeria welshimeri, Listeria innocua, Listeria monocytogenes, Listeria monocytogenes, Listeria monocytogenes, Staphylococcus carnosus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, | Q9KDK0, Q65GM7, A8FFS8, Q5WHS8, Q38WI4, A7Z781, A9VIR5, B7IIV2, P20964, Q72ZY5, Q6HD85, Q634A3, C1ETN7, AQRJ47, B7HQJ8, Q817U6, B9IZ16, B7JQ26, Q81LF0, B7HE73, Q88VG4, A8YV14, Q03QP2, Q043W1, Q5FKH5, Q74JN7, Q1WT46, B3WE52, Q039J3, Q834V4, A0A1Y6, Q92BH7, B8DHL1, Q71ZD3, Q8Y6Z3, B9DNE7, Q8CNZ7, Q5HNQ7, Q5HFB9, Q7A003, A6QHI6, A8Z2H2, Q6G8S5, Q7A584, Q99TK9, A5ITG8, Q2FXT1, Q2FG83, A7X361, A6U2B2, Q6GG60, Q2YT86, Q49Y82, Q4L6Y9, A4VUC8, A4W0M2, Q8DYL0, Q8E465, Q3K046, P0DB53, P0DB52, Q1JLA1, Q1JBB7, Q99Z94, Q48SX8, Q8P0I6, Q5XBM1, B5XLZ0, Q1JGD5, Q1J652, A2RE30, Q8DPV8, Q04KK7, Q97QW8, B5E4J4, B2IQ29, B1IBL9, B9DSH7, | O9Y295 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Staphylococcus haemolyticus, Streptococcus suis, Streptococcus suis, Streptococcus agalactiae, Streptococcus agalactiae, Streptococcus agalactiae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pneumoniae, Streptococcus pneumoniae, Streptococcus pneumoniae, Streptococcus pneumoniae, Streptococcus pneumoniae, Streptococcus pneumoniae, Streptococcus uberis, Streptococcus pneumoniae, Streptococcus equi, Streptococcus sanguinis, Streptococcus equi, Streptococcus equi, Streptococcus gordonii, Streptococcus mutans | B8ZPS8, B4U3Q7, A3CM33, C0MDB4, C0MBS1, A8AWM9, Q8DUU2 | |
| 2024 | VGGIRASLYNA | Stenotrophomonas maltophilia, Stenotrophomonas maltophilia | B45P45, B2FKF0 | Q9Y617 |
| 2025 | VGGRYSLWS | Sphingomonas wittichii | A5V9W3 | P06744 |
| 2026 | VGICGSDVH | Escherichia coli | P77280 | Q00796 |
| 2027 | VGICGSDVHY | Morganella morganii | Q59545 | Q00796 |
| 2028 | VGINGFGRIGR | Bacillus subtilis, Bacillus coagulans, Bacteroides fragilis, Corynebacterium glutamicum, Escherichia fergusonii, Escherichia coli, Escherichia coli, Escherichia coli, Streptomyces avermitilis, Streptomyces coelicolor, Streptomyces avermitilis | P09124, P15115, Q59199, Q01651, B7LQ20, P0A9B3, P0A9B2, P0A9B4, Q829W3, Q9Z518, Q82IZ2 | O14556 |
| 2029 | VGINGFGRIGRL | Streptococcus pyogenes, Streptococcus pyogenes, Streptococcus pyogenes, Streptococcus pyogenes, Streptococcus pyogenes, Streptococcus dysgalactiae | P0COG6, Q5XDW3, P68777, P0COG7, P0DB19, P0DB18, Q59906 | O14556 |
| 2030 | VGINGFGRIGRLVL | Escherichia coli | P33898 | O14556 |
| 2031 | VGINGFGRIGRLVLR | Escherichia coli | P58072 | O14556 |
| 2032 | VGKGITFDSGG | Citrobacter koseri, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Haemophilus influenzae, Haemophilus influenzae, Klebsiella pneumoniae, Klebsiella pneumoniae, Propionibacterium acnes | A8AD60, B7LKB6, B5Z0Z6, P58473, B1IWD8, A8A329, P37095, B1XAZ8, C4ZX98, Q8FF47, Q0TEW2, B7MYF7, B7UGW9, Q1R8K9, A1AE61, B7MI07, A7ZPW6, B6I595, B7M7M6, B7LDB5, B1LNH8, B7N6B0, B7NRH2, Q4QM33, P58474, A6TCE4, B5XNK4, Q6A9W5 | P28838 |
| 2033 | VGKGITFDSGGIS | Geobacter sulfurreducens | Q74GB4 | P28838 |
| 2034 | VGKGITFDSGGISIK | Geobacter sp. | C6E543 | P28838 |
| 2035 | VGKSSFINKV | Fusobacterium nucleatum | Q8RHS8 | Q9BZE4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2036 | VGLGNIWRFPY | Haemophilus influenzae | P44849 | Q9H1V8 |
| 2037 | VGLPAKSGV | Citrobacter koseri, Enterobacter sp., Escherichia coli, Escherichia coli, Escherichia coli, Klebsiella pneumoniae, Klebsiella pneumoniae, Ralstonia solanacearum | A8AGR2, A4WAF3, P0A6W0, P0A6W1, P0A6W2, A6T8Z6, B5XQU9, Q8XQS6 | O94925 |
| 2038 | VGLTGGIASGK | Haemophilus ducreyi | Q7VM70 | Q8WVC6 |
| 2039 | VGLTGGIASGKS | Propionibacterium acnes | Q6A9M5 | Q8WVC6 |
| 2040 | VGRLKTGTP | Arcobacter butzleri, Geobacter sulfurreducens, Geobacter uraniireducens, Geobacter metallireducens | A8EWV0, Q74604, A5G9V2, Q39PR0 | O9Y2Z2 |
| 2041 | VGRLKTGTPPRI | Acinetobacter baumannii, Acinetobacter baumannii, Acinetobacter baumannii, Acinetobacter baumannii, Acinetobacter baumannii, Acinetobacter baumannii, Acinetobacter baylyi, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Proteus mirabilis, Pseudomonas putida, Pseudomonas syringae, Pseudomonas syringae, Pseudomonas putida, Pseudomonas savastanoi, Pseudomonas putida, Pseudomonas stutzeri, Pseudomonas putida, Pseudomonas putida, Pseudomonas fluorescens, Pseudomonas aeruginosa, Pseudomonas aeruginosa, Pseudomonas aeruginosa, Pseudomonas aeruginosa, Pseudomonas mendocina, Pseudomonas fluorescens, Pseudomonas entomophila | B0V7I0, B7IC15, B7H0I9, A3M6R5, B2HUB2, B0VLL2, Q6F9Q1, B7UMK6, B6I3X8, B7NF57, P0A6U3, B1IWZ7, P0A6U4, B7NR43, Q0TAW8, A8A6K4, B1X9W9, B7N2I0, C4ZZ19, B7M597, B7L889, A7ZTV2, Q1R4J1, A1AHS1, B7MGG1, B5YXE5, Q8XAY0, B1LL68, B4F0D8, Q88RW8, Q87TS3, Q9F5X1, P25756, Q48BF4, A5WBB4, A4VS73, B0KRB9, B1JFV2, Q4K399, A6VF43, Q9HT09, B7V7A2, Q02DE3, A4Y198, Q3K430, Q1I2H6 | Q9Y2Z2 |
| 2042 | VGRNIIHGSDS | Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus | A7X2H3, P99068, A6QH18, Q2FGX3, A5ISZ7, Q2FYG7, A6U1T7, Q5HFV4, Q6GGU2, P68870, Q2YY87, P68869, A8Z448, Q6G994, Q8NWN1 | O60361 |
| 2043 | VGTDSHTTM | Corynebacterium jeikeium | Q4JVM4 | P21399 |
| 2044 | VGTGGTITG | Neisseria meningitidis | Q7DDL5 | P35520 |
| 2045 | VGTSSLRRA | Fusobacterium nucleatum | Q8RFP5 | P08397 |
| 2046 | VGTSSLRRAAQL | Listeria welshimeri | A0AJO5 | P08397 |
| 2047 | VHAENGELV | Pseudomonas aeruginosa, Pseudomonas putida | Q9I676, Q59699 | Q9BPU6 |
| 2048 | VHRDIKPGN | Corynebacterium glutamicum, Corynebacterium efficiens, Streptomyces coelicolor | Q8NU97, Q8FUI4, Q9S2C0 | Q14164 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2049 | VHRDLKPAN | *Streptomyces coelicolor* | P54739 | Q8IZL9 |
| 2050 | VHRDLKPQNIL | *Streptococcus pneumoniae, Streptococcus pneumoniae, Streptococcus pneumoniae, Streptococcus pneumoniae* | Q8DNS0, Q04J43, Q97PA9, Q8KY50 | O00534 |
| 2051 | VHRDLKPSN | *Streptomyces coelicolor, Streptomyces griseus* | P54741, P54742 | Q15418 |
| 2052 | VHSLKDLPT | *Streptomyces coelicolor, Streptomyces avermitilis* | Q9WX16, Q82E76 | P08397 |
| 2053 | VHSLKDLPTVLPPG | *Desulfitobacterium hafniense, Desulfitobacterium hafniense* | Q24VC8, B8G2M2 | P08397 |
| 2054 | VIAHRLSTI | *Bacillus subtilis, Escherichia coli, Escherichia coli, Escherichia coli* | Q07549, P0AAG5, P0AAG6, P0AAG7 | Q9NRK6 |
| 2055 | VIAHRLSTV | *Bacillus subtilis* | O06967 | Q9NUT2 |
| 2056 | VIGAWDVQF | *Rhizobium loti* | Q98EV8 | P06576 |
| 2057 | VIGKGGETI | *Enterococcus faecalis, Streptococcus mutans, Streptococcus equi, Streptococcus equi, Streptococcus equi, Streptococcus thermophilus, Streptococcus thermophilus, Streptococcus uberis, Streptococcus thermophilus, Streptococcus gordonii, Streptococcus sanguinis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus suis, Streptococcus suis, Streptococcus agalactiae, Streptococcus agalactiae, Streptococcus agalactiae, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes* | Q82ZJ2, Q8DW32, C0M913, C0MFB1, B4U573, Q5M6F9, Q5M1W9, B9DTE3, Q03MV9, A8AV53, A3CQG6, C1C076, B8ZMC0, C1C5V9, Q8DQT0, Q04LT4, B2IMQ9, B5E2A0, C1CCVV4, B1IAA9, Q97S28, A4VXQ4, A4W401, Q8E1Z8, Q3K3G9, Q8E7F6, Q1J9S6, Q5X9W0, Q1JJX5, Q48RA2, Q1JEW6, P0DD13, P0DD12, A2RGH2, Q1J4N2, B5XIK4, Q8NZC6, Q99XZ5 | Q96AE4 |
| 2058 | VIHFAGLKAVGESV | *Bifidobacterium longum, Neisseria meningitidis, Neisseria meningitidis, Neisseria gonorrhoeae, Neisseria meningitidis* | E8MF10, P56985, P56997, Q05026, P56986 | Q14376 |
| 2059 | VIHFAGLKAVGESVQKPL | *Escherichia coli* | P09147 | Q14376 |
| 2060 | VILDEPTAG | *Staphylococcus saprophyticus* | Q49ZD9 | O95477 |
| 2061 | VILGQDPYH | *Campylobacter jejuni* | A7H1G3 | P13051 |
| 2062 | VILGQDPYHG | *Neisseria meningitidis, Neisseria meningitidis, Neisseria meningitidis, Neisseria meningitidis* | A1KU26, Q9JZA1, A9LZA2, Q9JUC4 | P13051 |
| 2063 | VILGQDPYHGP | *Bacillus methylotrophicus* | A7ZA24 | P13051 |
| 2064 | VILTTGTFL | *Campylobacter jejuni, Campylobacter jejuni, Campylobacter jejuni, Campylobacter jejuni* | A8FMP4, Q5HTS6, A1W0H2, Q9PNA7, A7H2I7 | Q9Y2Z2 |
| 2065 | VILVGENPAS | *Streptococcus suis, Streptococcus suis* | A4VTM4, A4VZV9 | P13995 |
| 2066 | VIWGNPANTN | *Corynebacterium jeikeium* | Q4JWV0 | P40925 |
| 2067 | VKAQKVRRLI | *Acinetobacter baylyi, Acinetobacter baumannii, Acinetobacter baumannii, Acinetobacter baumannii, Acinetobacter baumannii,* | Q6FDY3, B0VS13, A3M8F1, B0VEN3, B7GXC5, B2HY00, B7I7N2 | Q9H0R6 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2068 | VKELVENSLDA reuteri | Acinetobacter baumannii, Acinetobacter baumannii Lactobacillus reuteri, Lactobacillus | B2G6E6, A5VIX0 | Q13670 |
| 2069 | VKELVENSLDAGA | Akkermansia muciniphila, Clostridium perfringens, Clostridium perfringens, Clostridium perfringens | B2ULE2, Q0STR3, Q0TRD5, Q8XL86 | Q13670 |
| 2070 | VKLSDYKGKY | Bacillus subtilis | Q796Y8 | P32119 |
| 2071 | VKMVHNGIEY | Staphylococcus aureus, Staphylococcus aureus, Staphylococcus aureus, Staphylococcus aureus, Staphylococcus aureus, Staphylococcus aureus, Staphylococcus epidermidis, Staphylococcus epidermidis | Q931R3, P63335, Q6GGI7, Q6G954, P63334, Q5HFR2, Q8CP47, Q5HP42 | P52209 |
| 2072 | VKMVHNGIEYGDMQLI | Bacillus subtilis | P80859 | P52209 |
| 2073 | VKRTGAIVDVPVG | Methylobacterium sp., Methylobacterium radiotolerans, Methylobacterium populi, Methylobacterium nodulans, Rhizobium sp., Rhizobium meliloti, Rhizobium leguminosarum, Rhizobium leguminosarum, Rhizobium etli, Rhizobium loti, Rhizobium etli | B0UE41, B1LVH1, B1ZEE9, B8IN03, C3M9S3, Q92LK6, Q1MAZ0, B5ZSN9, Q2K3G8, Q98EV6, B3PQ70 | P25705 |
| 2074 | VKSTLGPKG | Lactobacillus plantarum | Q88YM5 | P78371 |
| 2075 | VKVVILGQDPY | Bacteroides fragilis, Bacteroides fragilis | Q64QI5, Q5LA67 | P13051 |
| 2076 | VKVVILGQDPYH | Lactobacillus brevis, Campylobacter hominis, Campylobacter fetus, Porphyromonas gingivalis, Porphyromonas gingivalis | Q035K6, A7I0A8, A0RM89, B2RHL6, Q7MXF6 | P13051 |
| 2077 | VKVBVILGQDPYHG | Neisseria gonorrhoeae, Neisseria gonorrhoeae, Pediococcus ntosaceus | B4RLL6, Q5F8I7, Q03GV8 | P13051 |
| 2078 | VKVVILGQDPYHGP | Bacillus licheniformis, Bacillus pumilus, Lactobacillus sakei, Lactobacillus fermentum, Citrobacter koseri, Clostridium beijerinckii, Enterobacter sp., Listeria innocua, Listeria monocytogenes, Listeria monocytogenes, Pseudomonas fluorescens, Pseudomonas entomophila, Pseudomonas fluorescens, Pseudomonas putida, Pseudomonas fluorescens, Pseudomonas putida, Pseudomonas putida, Pseudomonas putida, Streptococcus pneumoniae, Streptococcus suis, Streptococcus suis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae | Q65DN9, A8FIM7, Q38VY5, B2GAM7, A8AD07, A6M317, A4WDE9, Q92EQ0, Q8Y9X7, Q723S4, Q3KGL4, Q1BT6, Q4KGS0, A5W8H2, C3KDS6, Q88N05, B0KV50, B1J4J3, B1IBW9, A4W30, A4W1D5, C1CRP5, C1QED4, P23379, B8Z048, Q8DPQ4, B5E4R3, Q04KE2, C1CKR8 | P13051 |
| 2079 | VKVVILGQDPYHGPNQA | Acinetobacter baumannii, Acinetobacter baumannii, Acinetobacter baumannii, Acinetobacter baumannii, Acinetobacter baumannii, Acinetobacter baumannii, Acinetobacter baylyi, Campylobacter curvus | B0VMZ7, A3M500, B2HZE0, B0VD25, B7I526, B7H3L4, Q6F9Y2, A7GVX1 | P13051 |
| 2080 | VKVVILGQDPYHGPNQAHG | Lactobacillus reuteri, Lactobacillus reuteri | A5VIJ2, B2G626 | P13051 |
| 2081 | VKVVILGQDPYHGPNQAHGL | Bacillus clausii, Enterococcus faecalis, Haemophilus ducreyi, Staphylococcus saprophyticus | Q5WAZ9, Q836Z5, Q7VMC0, Q49VD1 | P13051 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2082 | VKVVILGQDPYHGPNQAHGLCFSV | Aeromonas hydrophila, Aeromonas salmonicida | A0KMZ1, A4SK71 | P13051 |
| 2083 | VKVVILGQDPYHGPNQAHGLCFSVQ | Pseudomonas syringae, Pseudomonas savastanoi, Pseudomonas syringae | Q4ZPC2, Q48ET5, Q87XE2 | P13051 |
| 2084 | VKYSPDCIIIV | Bacillus licheniformis | Q65G89 | P07195 |
| 2085 | VLASASPRR | Desulfitobacterium hafniense, Clostridium acetobutylicum, Geobacter sulfurreducens, Geobacter metallireducens, Geobacter bemidjiensis, Geobacter sp. | Q24SM2, Q97JN3, Q74A46, Q39X87, B5EHR3, C6E559 | O95671 |
| 2086 | VLATNIAET | Escherichia coli | P37024 | Q7Z478 |
| 2087 | VLAYEPVWAIGTGKTA | Bacteroides fragilis, Bacteroides fragilis | Q64P83, Q5L923 | P60174 |
| 2088 | VLAYSGGLDT | Corynebacterium glutamicum, Corynebacterium glutamicum | O85176, A4QDZ4 | P00966 |
| 2089 | VLAYSGGLDTS | Aeromonas salmonicida, Aeromonas hydrophila, Lactobacillus reuteri, Lactobacillus reuteri, Lactobacillus casei, Bifidobacterium adolescentis, Bifidobacterium longum, Bifidobacterium longum, Bifidobacterium longum, Edwardsiella ictaluri, Geobacter sulfurreducens, Geobacter metallireducens, Geobacter daltonii, Geobacter sp., Geobacter uraniireducens, Geobacter bemidjiensis, Leuconostoc mesenteroides, Leuconostoc citreum, Listeria monocytogenes, Listeria monocytogenes, Listeria monocytogenes, Listeria welshimeri, Listeria innocua, Listeria monocytogenes, Staphylococcus carnosus, Staphylococcus saprophyticus, Staphylococcus epidermidis, Staphylococcus epidermidis, Staphylococcus haemolyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Streptococcus uberis | A4SIM5, A0KFV3, B2G6Y6, A5VJH1, Q033U7, A1A1W7, Q8G5F2, B3DSY7, B7GTP0, C5BC58, P61523, Q39Z72, B9M374, C6E6Y6, A5GDA4, B5ED13, Q03W70, B1MZP4, C1KX43, B8DH28, Q71XS4, A0AKJ7, Q929S9, Q8Y5H2, B9DIU4, Q49WA0, Q8CPU3, Q5HQK0, Q4L4X7, Q6GIC7, A8Z067, P63644, P63645, A6QFH2, A5IRD9, Q5HHC4, Q2FZU1, Q2FIB4, A7X0H5, A6U068, Q2YWS4, Q8NXF2, Q6GAW5, B9DW9 | P00966 |
| 2090 | VLDGGMGTMIQ | Escherichia coli | P13009 | Q99707 |
| 2091 | VLDVGCGSG | Haemophilus somnus | Q0I1M1 | Q86X55 |
| 2092 | VLDVGCGSGILS | Eubacterium rectale, Eubacterium eligens | C4ZAZ2, C4Z0Q0 | Q86X55 |
| 2093 | VLEARDRVGGRT | Kocuria rosea | P40974 | P21397 |
| 2094 | VLFIADEIQ | Staphylococcus saprophyticus | Q49W96 | P04181 |
| 2095 | VLFIADEIQTGL | Bacillus subtilis | P38021 | P04181 |
| 2096 | VLGAQWGDEGKGK | Clostridium botulinum, Clostridium botulinum, Clostridium botulinum, Clostridium botulinum, Clostridium botulinum, Clostridium botulinum, Clostridium botulinum, Clostridium botulinum, Clostridium botulinum, Clostridium acetobutylicum, Clostridium beijerinckii | B2V1S6, B2TRE4, C1FNL8, A7GJL2, B1IHP2, A5I7Y9, A7FZF9, C3KWG8, B1KU85, Q97D87, A6M3K0 | Q8N142 |
| 2097 | VLGEHGDSS | Lactobacillus plantarum | P59390 | P00338 |
| 2098 | VLGFPCNQF | Escherichia coli | P06610 | P18283 |
| 2099 | VLGIETSCD | Aeromonas hydrophila, Aeromonas salmonicida, Bacillus subtilis, Bacillus | A0KGI3, A4SRB1, O05518, Q65N07, | Q9H4B0 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | licheniformis, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Proteus mirabilis, Rhizobium loti | A8APV4, A4WEJ9, Q1R6R7, A1AFY6, Q0TD42, Q8FDG6, B7N068, B7MB00, Q8XBK3, B7UIX2, B7LQD8, B6I436, B1IRQ2, A8A4M1, B7LZL4, B7NJS7, B7LGZ9, B5YRA4, A7ZRU6, P05852, B1LF56, B7ND53, C4ZQY1, B1XG69, A6TE46, B5XU22, B4EW57, Q98Ei6 | |
| 2100 | VLIIGSGGREH | Pseudomonas aeruginosa, Pseudomonas syringae, Pseudomonas putida | Q9HUV8, Q87VR8, Q88DK2 | P22102 |
| 2101 | VLILDEATS | Streptococcus pneumoniae, Streptococcus pneumoniae | P59653, Q03727 | Q9NUT2 |
| 2102 | VLITGCSSGIGL | Escherichia coli, Escherichia coli | P0AFP5, P0AFP4 | P14061 |
| 2103 | VLIVEDIID | Escherichia coli, Escherichia coli | P0A9M3, P0A9M2 | P00492 |
| 2104 | VLIVEDIIDTG | Haemophilus influenzae | P45078 | P00492 |
| 2105 | VLLGPPGAGKGTQA | Clostridium perfringens, Clostridium perfringens, Clostridium perfringens, Clostridium beijerinckii, Clostridium botulinum, Clostridium botulinum, Corynebacterium ur TABLE 1-continued Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
|  |  | Corynebacterium glutamicum, Corynebacterium efficiens, Kocuria rhizophila, Micrococcus luteus, Streptomyces coelicolor, Streptomyces griseus, Streptomyces avermitilis | B1W463, Q827Q7 |  |
| 2122 | VNDAFGTAHR | Lactobacillus reuteri, Lactobacillus brevis, Lactobacillus acidophilus, Lactobacillus helveticus, Lactobacillus johnsonii, Lactobacillus casei, Lactobacillus casei, Lactobacillus salivarius, Lactobacillus gasseri, Lactobacillus delbrueckii, Lactobacillus delbrueckii, Lactobacillus delbrueckii, Lactobacillus delbrueckii, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus carnosus, Staphylococcus epidermidis, Staphylococcus epidermidis, Staphylococcus haemolyticus, Staphylococcus saprophyticus, Streptococcus suis, Streptococcus suis, Streptococcus equi | B2G616, Q03SL7, Q5FL50, A8YUE3, P62413, B3WCVV5, Q03AK6, Q1WTB5, Q042F2, Q8GIZ5, Q1GB26, O32756, Q04BH1, Q2YSF1, A8Z1A1, Q2G031, P68820, Q2FIM0, P68821, A6QF82, Q6GB57, A7WZS6, P68819, A6TZQ2, Q6GIL7, P99135, Q5HHP4, A5IQX7, B9DJJ6, Q5HQV3, Q8CTD6, Q4L4K4, Q49W00, A4VSN8, A4VYY1, B4U0W3 | P07205 |
| 2123 | VNDAFGTAHRA | Neisseria meningitidis, Neisseria meningitidis, Neisseria meningitidis, Neisseria meningitidis, Neisseria gonorrhoeae, Neisseria gonorrhoeae | A1KWN6, A9LZI3, Q9JW58, Q9K1R0, B4RPR1, Q5F5K5 | P07205 |
| 2124 | VNDAFGTAHRAH | Akkermansia muciniphila, Lactobacillus sakei, Clostridium novyi, Clostridium tetani, Clostridium kluyveri, Clostridium kluyveri, Clostridium perfringens, Clostridium perfringens, Clostridium perfringens, Clostridium botulinum, Clostridium botulinum, Clostridium botulinum, Clostridium botulinum, Clostridium botulinum, Clostridium botulinum, Clostridium botulinum, Clostridium botulinum, ptoclostridium difficile, Clostridium beijerinckii, Enterococcus faecalis, Pediococcus ntosaceus, Streptococcus pyogenes, Streptococcus sanguinis, Streptococcus pyogenes, Streptococcus pyogenes, Streptococcus pyogenes, Streptococcus pyogenes, Streptococcus pyogenes, Streptococcus agalactiae, Streptococcus agalactiae, Streptococcus agalactiae, Streptococcus pyogenes, Streptococcus thermophilus, Streptococcus thermophilus, Streptococcus pyogenes, Streptococcus pyogenes, | B2UKW8, Q38Y20, A0PYP1, Q898R3, B9E6B4, A5N2N8, Q8XKU0, Q0TQY7, Q0STD5, B2UY23, C1FQW3, A5HYC0, A7FQN7, A7G9Y0, C3KYR4, B1IDB6, B2TPX4, B1KTJ5, Q181T8, A6LR05, Q833I9, Q03GW7, B5XIF1, A3CKQ4, Q8NZG3, Q1J9Y4, Q1JK32, Q5XA18, P68897, Q8DXT0, Q3JZB8, Q8E3F0, A2RCM1, Q8VVB6, Q03IS8, P0DD05, Q48RF9, P0DD04, Q1J4X9, Q8DW2, Q5LY23, A8AUR9, B9DVS0, C1C5M3, Q8D0X8, B2IMA2, C1CCP3, C1CIZ1, C1CQ04, Q04LZ5, B8ZLX5, B1IA36, Q97S89, C0M940, C0MF22, B5E1U9 | P07205 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Streptococcus pyogenes, Streptococcus pyogenes, Streptococcus mutans, Streptococcus thermophilus, Streptococcus gordonii, Streptococcus uberis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus equi, Streptococcus equi, Streptococcus pneumoniae* | | |
| 2125 | VNGAGLAMAT | *Acinetobacter baylyi, Acinetobacter baumannii, Acinetobacter baumannii, Acinetobacter baumannii, Acinetobacter baumannii, Acinetobacter baumannii, Acinetobacter baumannii, Akkermansia muciniphila, Bacillus cytotoxicus, Bacillus cereus, Bacillus cereus, Bacillus halodurans, Bacillus thuringiensis, Bacillus cereus, Bacillus cereus, Bacillus cereus, Bacillus cereus, Bacillus cereus, Bacillus thuringiensis, Bacillus cereus, Bacillus anthracis, Bacillus anthracis, Bacillus anthracis, Bacillus clausii, Bacillus weihenstephanensis, Bacteroides thetaiotaomicron, Campylobacter jejuni, Campylobacter jejuni, Campylobacter jejuni, Campylobacter jejuni, Campylobacter jejuni, Campylobacter curvus, Geobacter lovleyi, Neisseria gonorrhoeae, Neisseria meningitidis, Neisseria meningitidis, Neisseria gonorrhoeae, Neisseria meningitidis, Neisseria meningitidis, Ralstonia pickettii, Ralstonia solanacearum, Rhizobium meliloti, Rhizobium leguminosarum, Rhizobium loti, Rhizobium leguminosarum, Rhizobium etli, Rhizobium etli, Sphingomonas wittichii, Staphylococcus saprophyticus, Staphylococcus epidermidis, Staphylococcus epidermidis, Stenotrophomonas maltophilia, Stenotrophomonas maltophilia* | Q6F8L4, B0VEF2, A3M887, B7I6T2, B2HXG0, B7GXK7, B0VSL0, B2UMH5, A7GRG6, B7HDV9, B7IUJ5, Q9KA20, Q6HEX9, B9IVC5, Q636J0, B7HLG9, C1EP60, Q732N4, A0RHK9, Q819X0, Q81WK0, C3L791, C3P5N7, Q5WFP4, A9VT74, Q8A9M7, A8FKV6, Q5HVN3, Q9PHY1, A1VYP2, A7H4K9, A7GYI5, B3E7B3, B4RL77, Q9JUT0, Q9JZP4, Q5F878, A1KTM6, A9M4F8, B2UGE2, Q8Y1Y3, Q9EYG9, Q1MAW1, Q98EC5, B5ZSR9, Q2K3F0, B3PQ90, A5VB78, Q49X32, Q8CPH5, Q5HPU5, B2FRS3, B4ST72 | Q96I99 |
| 2126 | VNGVAKIHSDI | *Bacillus subtilis* | P39123 | P06737 |
| 2127 | VNKSQSSND | *Escherichia coli, Escherichia coli, Escherichia coli* | Q8X769, P05042, Q8FHA7 | P07954 |
| 2128 | VNKSQSSNDT | *Haemophilus ducreyi* | Q7VKC9 | P07954 |
| 2129 | VNKSQSSNDTFPT AMH | *Staphylococcus epidermidis, Staphylococcus epidermidis* | Q8CNR1, Q5HN85 | P07954 |
| 2130 | VNKSQSSNDTFPT AMHIAA | *Haemophilus influenzae* | P71384 | P07954 |
| 2131 | VNLTNHSYFNL | *Acinetobacter calcoaceticus* | P05149 | Q96C23 |
| 2132 | VNQGHCHPKI | *Staphylococcus saprophyticus* | Q4A0N2 | P04181 |
| 2133 | VNRIAAGEV | *Sphingomonas wittichii* | A5V3J3 | P40692 |
| 2134 | VNTTDSAVR | *Eubacterium eligens, ptoclostridium difficile, Clostridium phytofermentans, Desulfovibrio maeticus* | C4Z154, Q180Y2, A9KHD4, C4XIQ1 | Q9UGC7 |
| 2135 | VNTTDSAVRI | *Campylobacter curvus, Campylobacter concisus, Campylobacter jejuni, Campylobacter jejuni, Campylobacter jejuni,* | A7GW12, A7ZB10, Q5HSH9, A1W1L4, A8FNS3, Q9PM63, A7H5W3, A7I3Q0, | Q9UGC7 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Campylobacter jejuni, Campylobacter jejuni, Campylobacter hominis, Campylobacter lari, Clostridium perfringens, Clostridium perfringens, Clostridium perfringens, Clostridium kluyveri, Clostridium acetobutylicum, Helicobacter hepaticus, Helicobacter pylori, Helicobacter pylori, Helicobacter acinonychis, Helicobacter pylori, Helicobacter pylori, Helicobacter pylori | B9KE98, Q0SQY1, Q0TNB0, Q8XIB9, A5N3J7, Q97F68, Q7VFA0, B6JP10, B5Z680, Q17VT1, P55998, Q1CV77, Q9ZMZ0 | |
| 2136 | VNVQGTRNV | Escherichia coli | Q8X7P7 | Q9H2F3 |
| 2137 | VPAGVEDGQ | Lactobacillus sakei, Lactobacillus sakei, Pediococcus ntosaceus | O87778, Q38W94, Q03FR6 | Q96EY1 |
| 2138 | VPEEYGGLG | Bacillus subtilis | O32176 | Q9H845 |
| 2139 | VPESPRWLI | Bacillus subtilis | P94493 | O75751 |
| 2140 | VPETKGKTLE | Escherichia coli, Escherichia coli | P0AGF4, P0AGF5 | Q9NY64 |
| 2141 | VPETKGRSLEQ | Bacillus subtilis | P54723 | Q9UGQ3 |
| 2142 | VPGGFGIRG | Lactobacillus delbrueckii | Q04C51 | Q9NRF8 |
| 2143 | VPIGRGQRELIIGD | Clostridium phytofermentans | A9KK94 | P25705 |
| 2144 | VPIGRGQRELIIGDRQTGKT | Fusobacterium nucleatum, Clostridium thermocellum, Geobacter lovleyi, Geobacter daltonii, Geobacter sulfurreducens, Geobacter uraniireducens, Geobacter sp., Geobacter bemidjiensis | Q8RGE0, A3DIM7, B3EA03, B9LZ86, Q74GY2, A5G9D6, C6E9F3, B5EFI9 | P25705 |
| 2145 | VPLIGFAGAP | Bacillus pumilus, Listeria innocua, Listeria monocytogenes, Listeria welshimeri, Listeria monocytogenes, Listeria monocytogenes, Listeria monocytogenes | A8FBM5, Q929G1, Q8Y564, A0AKW5, Q71XF3, B8DF98, C1KXG7 | P06132 |
| 2146 | VPVGEELLGRVV | Bacillus halodurans, Bacillus pseudofirmus | Q9K6H3, P22477 | P25705 |
| 2147 | VQSLGGTGALRI | Haemophilus influenzae | P44425 | P17174 |
| 2148 | VRENTEGEYSSL | Escherichia coli, Pseudomonas putida | P76251, Q51945 | P51553 |
| 2149 | VRFAPSPTG | Desulfitobacterium hafniense | Q250Q8 | Q5JPH6 |
| 2150 | VRFSTVAGE | Bacteroides fragilis, Desulfovibrio vulgaris | P45737, Q9ZN99 | P04040 |
| 2151 | VRGGGRKPW | Lactobacillus sakei, Enterococcus faecalis, Pediococcus ntosaceus, Staphylococcus carnosus, Staphylococcus saprophyticus, Staphylococcus epidermidis, Staphylococcus epidermidis, Staphylococcus haemolyticus | Q38UR3, Q839G3, Q03EB7, B9DM18, Q49ZG7, Q8CRG1, Q5HM00, Q4L8B3 | Q9BYD3 |
| 2152 | VRGKDVFIIQ | Pseudomonas syringae, Pseudomonas putida | Q888C6, Q88PX6 | O60256 |
| 2153 | VRGVAMNPV | Geobacter lovleyi, Geobacter metallireducens, Geobacter uraniireducens, Ralstonia solanacearum | B3E7T8, Q39Y03, A5GAW8, Q8XV15 | P62917 |
| 2154 | VRVRFAPSPTG | Bacillus halodurans, Parabacteroides distasonis, Bacteroides thetaiotaomicron, Bacteroides fragilis, Bacteroides fragilis, Bacteroides vulgatus | Q9KGF6, A6LEA1, Q8A455, Q64NI3, Q5L883, A6L0E8 | Q5JPH6 |
| 2155 | VRVRFAPSPTGF | ptoclostridium difficile | Q18CD6 | Q5JPH6 |
| 2156 | VRVRFAPSPTGFLH | Finegoldia magna | B0S0W2 | Q5JPH6 |
| 2157 | VSEAGASIYS | Neisseria meningitidis, Neisseria meningitidis, Neisseria gonorrhoeae | P57072, Q51152, Q51062 | Q8N5C6 |
| 2158 | VSEDMLGRVF | Clostridium botulinum, Clostridium botulinum, Clostridium tetani, Clostridium perfringens, Clostridium perfringens, Clostridium perfringens, Clostridium botulinum, Clostridium botulinum, Clostridium botulinum, Clostridium botulinum, Clostridium botulinum, Clostridium botulinum, Clostridium botulinum | B2TP90, B2UWY3, Q896K3, Q0TPW8, Q0SSI3, Q8XJW6, A7GGL3, B1IJM7, B1KXT5, C1FTN6, A51556, A7FWQ6, C3L1B0 | P15313 |
| 2159 | VSGGTDNHL | Aeromonas salmonicida, Aeromonas hydrophila | A4SJN4, A0KNH4 | P34897 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2160 | VSHGATGKGNDQVRFEL | Sphingomonas wittichii | A5VAK5 | P00966 |
| 2161 | VSNHGGRQLD | Acinetobacter baylyi, Acinetobacter baumannii, Acinetobacter baumannii, Acinetobacter baumannii, Acinetobacter baumannii, Acinetobacter baumannii, Acinetobacter baumannii, Citrobacter koseri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Haemophilus influenzae, Haemophilus influenzae, Haemophilus influenzae, Haemophilus influenzae, Haemophilus ducreyi, Klebsiella pneumoniae, Klebsiella pneumoniae, Pseudomonas entomophila, Pseudomonas putida, Pseudomonas aeruginosa, Pseudomonas putida, Pseudomonas putida, Pseudomonas aeruginosa, Pseudomonas putida, Pseudomonas aeruginosa, Pseudomonas aeruginosa, Pseudomonas syringae, Pseudomonas fluorescens, Stenotrophomonas maltophilia, Stenotrophomonas maltophilia | Q6FFS1, B0VND0, B7IBS4, B0V6L1, A3M0X0, B2I061, B7H2H0, A8ARJ1, A4W540, B7NER0, P33232, B1IZ15, A8A670, B1X8M0, C4ZXJ7, B1LK44, B6BI4, B7M492, B5YWA7, Q8XDF7, B7L725, A7ZTF9, B7N251, B7ULG1, Q1R4Z0, B7MFG9, Q8FCB1, Q0TBK1, B7NPB4, A1AHE2, B7LTL2, P46454, A5UFG9, A5UBE3, Q4QJK8, Q7VPI9, A6TFK0, B5XMV0, Q1IF69, B1J244, A6VCM8, A5W9B2, Q88DT3, Q02FQ1, B0KIT4, Q9HV37, B7V113, Q4ZY06, C3K053, B4SMK1, B2FIJ0 | Q9NYQ3 |
| 2162 | VSNPVDILTY | Clostridium acetobutylicum, Clostridium perfringens, Clostridium perfringens, Clostridium perfringens | Q97MD1, Q0SWR1, Q0TUX8, Q8XP62 | Q9BYZ2 |
| 2163 | VSNPVDILTYV | Clostridium tetani | Q892U0 | Q9BYZ2 |
| 2164 | VSSDRGLCG | Geobacter uraniireducens, Pseudomonas putida, Pseudomonas putida, Pseudomonas putida, Pseudomonas entomophila, Pseudomonas fluorescens, Pseudomonas syringae, Pseudomonas savastanoi, Pseudomonas syringae, Pseudomonas putida, Pseudomonas fluorescens, Pseudomonas fluorescens, Pseudomonas aeruginosa, Pseudomonas aeruginosa, Pseudomonas aeruginosa, Pseudomonas aeruginosa | A5G9D7, Q88BX3, A5WBA4, B0KRA9, Q1I2I6, Q3K440, Q4ZL23, Q48BG4, Q87TT3, B1JFU2, C3K1E7, Q4K3A8, B7V792, Q9HT19, Q02DF3, A6VF33 | P36542 |
| 2165 | VTAGLAIYDTMQYI | Eubacterium rectale | C4ZGF4 | Q16740 |
| 2166 | VTFHRAFDM | Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli | A8AFG8, C5B835, A4WBM9, B1LCZ7, B7NS44, B5YR19, Q8XCH4, A8A176, B1J0L4, Q8FGQ2, Q0TGV9, B7USQ1, B7MW68, B7L7S7, B7NBM5, B6IIF2, P67826, B1XHE2, B7M2G5, C4ZQF8, A7ZNQ0, Q1RAR0, B7MBT3, A1AC35 | Q9NTM9 |
| 2167 | VTGAAGQIAYSLL | Akkermansia muciniphila, Corynebacterium diphtheriae, Corynebacterium efficiens | B2UKY5, P61974, Q8FN62 | P40925 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2168 | VTGAAQGIGR | *Acinetobacter baylyi* | P07772 | P15428 |
| 2169 | VTGAGKGIG | *Escherichia coli* | P15047 | Q7Z4W1 |
| 2170 | VTGAGSGIG | *Staphylococcus aureus, Staphylococcus aureus, Staphylococcus aureus, Staphylococcus aureus, Staphylococcus aureus, Staphylococcus aureus, Staphylococcus aureus, Staphylococcus aureus* | Q8NUV9, Q6G6J1, Q99RF5, Q7A3L9, Q6GDV6, Q2FVD5, Q5HD73, Q2FE21 | Q92506 |
| 2171 | VTGASRGIG | *Pseudomonas aeruginosa* | O54438 | Q96LJ7 |
| 2172 | VTGASRGIGR | *Bacillus subtilis, Escherichia coli* | P51831, P0AEK2 | Q96LJ7 |
| 2173 | VTGASSGIG | *Rhizobium sp., Staphylococcus saprophyticus* | P55434, Q4A054 | Q9Y394 |
| 2174 | VTGASSGIGE | *Staphylococcus epidermidis, Staphylococcus epidermidis* | Q5HLD8, Q8CN40 | Q9Y394 |
| 2175 | VTGSTSGIG | *Bacillus subtilis* | Q32229 | Q13268 |
| 2176 | VTILGHVQRGGTP | *Finegoldia magna* | B0S230 | Q01813 |
| 2177 | VTIMGHVDHGKT | *Rhizobium meliloti* | Q92SW4 | P46199 |
| 2178 | VTLELGGKNP | *Escherichia coli* | P80668 | P43353 |
| 2179 | VTLELGGKSP | *Bacillus subtilis, Bacillus subtilis, Pseudomonas oleovorans* | P46329, O34660, P12693 | P51648 |
| 2180 | VTLYHWDLPQ | *Bifidobacterium breve* | P94248 | Q9UEF7 |
| 2181 | VTTTHKTLRG | *Lactobacillus sakei, Lactobacillus reuteri, Lactobacillus reuteri, Clostridium beijerinckii, Clostridium botulinum, Clostridium botulinum, Clostridium botulinum, Clostridium botulinum, Clostridium botulinum, ptoclostridium difficile, Clostridium botulinum, Clostridium botulinum, Pseudomonas aeruginosa, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus, Staphylococcus aureus, Staphylococcus aureus, Staphylococcus aureus, Staphylococcus haemolyticus, Staphylococcus epidermidis, Staphylococcus epidermidis* | Q38WJ7, A5VIP9, B2G679, A6LUK9, A7GGI2, B1IJJ8, B1KXQ5, C3L181, C1FTF1, Q183G0, A5I526, A7FWM6, Q9HVI7, P66804, Q6G7J7, Q6GEW2, P66803, P99091, A6QIV7, Q5HE87, Q2FWE5, A5IUQ8, A7X4V7, A6U3J8, Q49Z60, Q2YUJ1, A8YY80, Q2FF15, Q4L7Z4, Q8CRN3, Q5HMB0 | P34897 |
| 2182 | VVAGETGSGK | *Haemophilus influenzae* | P45018 | Q7Z478 |
| 2183 | VVAHRLSTV | *Streptomyces coelicolor* | Q9ZNB0 | Q9NP58 |
| 2184 | VVAIGECGLDF | *Citrobacter koseri, Citrobacter rodentium, Enterobacter sp., Enterobacter liolyticus, Escherichia coli, Escherichia fergusonii, Klebsiella pneumoniae* | A8ACY8, D2TUZ4, A4WFX9, E3G381, P27859, B7LTZ5, B5XYH5 | Q6P1N9 |
| 2185 | VVDDLLATGGT | *Aeromonas hydrophila, Aeromonas salmonicida, Fusobacterium nucleatum, Citrobacter koseri, Clostridium beijerinckii, Enterobacter sp., Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli,* | A0KKD3, A4SMN3, Q8RDM9, A8AJX4, A6LTN5, A4W7F3, Q8XD48, B5Z3X9, B7LLQ1, Q1RF67, P69504, B1XFQ6, Q0TKH2, B7M3W1, B1LJM6, B6I0C1, B7N922, C4ZUS3, B1IZC5, A1A8D5, B7NIG1, B7MDZ1, A7ZXC7, B7L794, P69503, B7UKE9, A7ZIM8, B7MQI4, Q7VKQ4, B5Y0N8, | P07741 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Haemophilus ducreyi, Klebsiella pneumoniae, Klebsiella pneumoniae* | A6T5N2 | |
| 2186 | VVGNPANTN | *Acinetobacter baylyi, Acinetobacter baumannii, Acinetobacter baumannii, Acinetobacter baumannii, Acinetobacter baumannii, Acinetobacter baumannii, Acinetobacter baumannii, Corynebacterium glutamicum, Corynebacterium glutamicum, Ralstonia solanacearum, Ralstonia pickettii, Stenotrophomonas maltophilia, Stenotrophomonas maltophilia, Streptomyces coelicolor, Streptomyces avermitilis, Streptomyces griseus* | Q6F7X1, B0V6R7, A3M928, B2HZ52, B7I9D2, B7GW58, B0VQX5, Q8NN33, A4QGA0, Q8XXW5, B2U705, B2FQL8, B4SLI5, Q9K3J3, Q82HS2, B1W3N4 | P40925 |
| 2187 | VVGPEAPLAAGIV | *Ralstonia solanacearum* | Q8XXC4 | P22102 |
| 2188 | VVGTSSLRR | *Bacillus licheniformis, Desulfovibrio salexigens, Desulfovibrio alaskensis, Neisseria meningitidis, Neisseria meningitidis, Ralstonia solanacearum* | Q65GK1, C6BYB7, Q30Y29, Q9JVS4, Q9K0P6, Q8XWW3 | P08397 |
| 2189 | VVIGADTIV | *Bacillus pumilus* | A8FFU1 | O95671 |
| 2190 | VVILGQDPYHG | *Haemophilus somnus, Pseudomonas denitrificans, Ralstonia pickettii, Rhizobium meliloti* | Q0I271, P29950, B2UDL1, Q92LU5 | P13051 |
| 2191 | VVILGQDPYHGPNQA | *Streptococcus thermophilus* | Q03KM6 | P13051 |
| 2192 | VVILGQDPYHGPNQAHGL | *Proteus mirabilis* | B4F058 | P13051 |
| 2193 | VVIVRDDLLG | *Pseudomonas stutzeri* | Q9R102 | Q9Y617 |
| 2194 | VVKHEVTGL | *Bacillus subtilis* | O34413 | Q96MS3 |
| 2195 | VVKRLPKTRSGK | *Pseudomonas aeruginosa* | P28812 | Q9NUB1 |
| 2196 | VVLAYSGGLDT | *Eubacterium rectale, Corynebacterium urealyticum, Corynebacterium jeikeium* | C4Z9C9, B1VH30, Q4JVZ8 | P00966 |
| 2197 | VVLAYSGGLDTS | *Arcobacter butzleri, Lactobacillus salivarius, Bacillus halodurans, Bacillus pumilus, Bacillus licheniformis, Bacillus clausii, Bacillus subtilis, Bacillus cytotoxicus, Bacillus cereus, Bacillus cereus, Bacillus thuringiensis, Bacillus anthracis, Bacillus anthracis, Bacillus anthracis, Bacillus methylotrophicus, Bacillus thuringiensis, Bacillus cereus, Bacillus cereus, Bacillus cereus, Bacillus weihenstephanensis, Bacillus cereus, Bacillus cereus, Bacillus cereus, Bacillus cereus, Desulfitobacterium hafniense, Desulfitobacterium hafniense, Campylobacter fetus, Campylobacter curvus, Campylobacter hominis, Campylobacter concisus, Campylobacter jejuni, Campylobacter lari, Campylobacter jejuni, Campylobacter jejuni, Campylobacter jejuni, Campylobacter jejuni, Clostridium novyi, Clostridium tetani, Clostridium kluyveri, Clostridium kluyveri, ptoclostridium difficile, Clostridium botulinum, Clostridium botulinum, Clostridium botulinum, Clostridium botulinum, Clostridium botulinum, Clostridium acetobutylicum, Clostridium botulinum, Clostridium botulinum, Clostridium beijerinckii, Corynebacterium diphtheriae, Corynebacterium efficiens, Corynebacterium kropnstedtii, Desulfovibrio alaskensis,* | A8EUB2, Q1WV65, Q9K820, A8FG70, Q65G67, Q5WED8, O34347, A7GTR5, Q633G4, C1EUX9, A0RJM4, Q81KV7, C3L9T6, C3PB97, A7Z7M0, Q6HCP7, B7JS06, B9J0E1, P61520, A9VKE1, B7HRS7, Q817C6, B7H6Y5, B7IK29, B8FWX2, Q24ZG8, A0RP84, A7GYN4, A7I281, A7ZDF2, Q9PHK7, B9KG97, A8FL83, A1VZ24, Q5HVA9, A7H4E9, A0Q1Z2, P59602, A5N6U2, B9E0B1, Q186Z6, C1FU68, A7GGQ9, A5I5A4, A7FWU6, C3L1U3, Q97KE6, B1KXY1, B1IK08, A6M1Z4, P61521, Q8FTM9, C4LIE1, Q30Y138, B8DN64, P61522, A1VEQ0, Q7VGU9, B2GKD7, Q4K749, Q3K7K0, B7UW5, Q9HY84, Q02QZ6, A6V1S1, Q48F14, Q87XM3, C3KBZ2, A4VIU7, Q4ZPK0, A4XS43, B1J4I4, P59604, A5VZI0, | P00966 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Desulfovibrio vulgaris, Desulfovibrio vulgaris, Desulfovibrio vulgaris, Helicobacter hepaticus, Kocuria rhizophila, Pseudomonas fluorescens, Pseudomonas fluorescens, Pseudomonas aeruginosa, Pseudomonas aeruginosa, Pseudomonas aeruginosa, Pseudomonas aeruginosa, Pseudomonas savastanoi, Pseudomonas syringae, Pseudomonas fluorescens, Pseudomonas stutzeri, Pseudomonas syringae, Pseudomonas mendocina, Pseudomonas putida, Pseudomonas putida, Pseudomonas putida, Pseudomonas entomophila, Pseudomonas putida, Rhizobium meliloti, Rhizobium leguminosarum, Rhizobium etli, Rhizobium loti, Streptomyces avermitilis, Streptomyces griseus, Streptomyces clavuligerus | Q11E03, B0KUE7, Q92L73, Q1MAN9, Q2K3B7, Q98E81, Q827Z1, B1W3B3, P50986 | |
| 2198 | VVLGAQWGDEGKGK | Clostridium novyi, Clostridium perfringens, Haemophilus somnus, Stenotrophomonas maltophilia | A0PXA8, Q8XH63, Q0I4O5, B4SS80 | Q8N142 |
| 2199 | VVLGHSERR | Clostridium botulinum, Clostridium botulinum, Clostridium beijerinckii | B2UY22, B2TPX3, A6LRO6 | P60174 |
| 2200 | VVLVGGSTR | Corynebacterium glutamicum, Corynebacterium glutamicum | A4QHJ0, Q8NLY6 | P48723 |
| 2201 | VVPESPRWL | Bacillus subtilis | P96710 | O75751 |
| 2202 | VVTEAGFGAD | Leuconostoc mesenteroides | Q03YB1 | P11586 |
| 2203 | VVTIMGHVDHGKTTLLD | Bacillus cereus, Bacillus cereus, Bacillus cereus, Bacillus cereus, Bacillus anthracis, Bacillus anthracis, Bacillus anthracis, Bacillus anthracis, Bacillus thuringiensis, Bacillus cereus, Bacillus thuringiensis, Bacillus cereus, Bacillus cereus, Bacillus cereus, Bacillus cereus, Bacillus cytotoxicus, Bacillus weihenstephanensis, Staphylococcus carnosus, Staphylococcus epidermidis, Staphylococcus epidermidis, Staphylococcus saprophyticus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus haemolyticus | B9IVA1, B7HLE6, Q73209, Q81WM3, C3P5L5, C3L7B4, Q6HF02, Q636L3, A0RHI4, C1EP35, Q812X7, B7HDT6, B7IUH1, A7GRE3, A9VT50, B9DPF5, Q8C5T4, Q5HPS2, Q49X54, P65134, P65133, Q2YXP7, A5ISF3, A7X1Q1, A6U188, Q6GHG6, A8Z3U9, A6QGG8, Q5HGG2, Q2G2D0, Q2FHG9, Q8NWZ1, Q6G9U4, Q4L5X1 | P46199 |
| 2204 | VVVGPEAPL | Streptomyces coelicolor | Q9RKL4 | P22102 |
| 2205 | VVYGITTGFGKF | Bacillus cereus, Bacillus cereus, Bacillus cereus, Bacillus anthracis, Bacillus anthracis, Bacillus anthracis, Bacillus cereus, Bacillus cytotoxicus, Bacillus weihenstephanensis, Bacillus cereus, Bacillus cereus, Bacillus cereus, Bacillus thuringiensis, Bacillus cereus, Bacillus thuringiensis, Bacillus cereus | Q733H8, Q637H8, B7J180, Q81Y45, C3L982, C3P4M2, Q81AC6, A7GRO0, A9VPT8, B7HCD0, B9IUH0, B7HKJ1, Q6HFE9, B7I5J2, A0RH39, C1EN93 | P42357 |
| 2206 | VWCSNDYLGM | Rhizobium radiobacter, Rhizobium mel iloti | P26505, P08080 | P22557 |
| 2207 | VWQTGSGTQ | Bacillus halodurans | Q9KCX4 | P07954 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2208 | VWVDLEMTGLD | *Corynebacterium glutamicum, Corynebacterium glutamicum, Corynebacterium efficiens* | Q8NMU1, A4QGM5, Q8FMX9 | Q9Y3B8 |
| 2209 | VWVSEVMLQQT | *Bacillus subtilis* | O31584 | Q9UIF7 |
| 2210 | VYDQMPEPRYV | *Desulfovibrio desulfuricans* | B8J1D6 | O75251 |
| 2211 | VYGITTGFG | *Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | A8YYT1, A60D47, Q5HJY8, Q2G2P7, Q2FKP8, Q2YUR3, Q8NYY3, Q6GD82, P64416, P64415, A5INP9, A6TXF8, Q6GKT7 | P42357 |
| 2212 | WAHLDIAGV | *Desulfovibrio desulfuricans, Methylobacterium extorquens, Methylobacterium extorquens, Methylobacterium populi, Methylobacterium radiotolerans* | B8J457, B7KYK4, A9VXD6, B1ZAK8, B1LVC3 | P28838 |
| 2213 | WAIGTGKTA | *Acinetobacter baumannii, Acinetobacter baumannii, Acinetobacter baumannii, Acinetobacter baumannii, Acinetobacter baumannii, Acinetobacter baumannii, Lactobacillus helveticus, Lactobacillus acidophilus, Lactobacillus delbrueckii, Lactobacillus delbrueckii, Lactobacillus delbrueckii, Lactobacillus delbrueckii, Lactobacillus gasseri, Lactobacillus johnsonii, Lactobacillus sakei, Finegoldia magna, Pediococcus ntosaceus, Rhizobium etli* | B7H1F6, B2I2M3, B0VLU6, A3M1K0, B0VE65, B7I3R5, A8YUE4, Q5FL49, Q04BH0, Q1GB25, O32757, Q93GB7, Q042F3, Q74K79, Q38Y19, B0S1G9, Q03GW6, P96985 | P60174 |
| 2214 | WAIGTGKTAT | *Lactobacillus casei, Lactobacillus casei, Lactobacillus salivarius, Lactobacillus plantarum, Clostridium tetani, Clostridium kluyveri, Clostridium novyi, Clostridium thermocellum, Clostridium botulinum, Clostridium botulinum, Clostridium botulinum, Clostridium acetobutylicum, Clostridium perfringens, Clostridium perfringens, Clostridium perfringens* | B3WCVV6, Q03AK5, Q1WSX9, Q88YH4, Q898R2, A5N2N7, A0PYP2, A3DBQ1, B1KTJ6, A7FQN8, A7G9Y1, B1IDB7, O52633, Q8XKU1, Q0TQY8, Q0STD6 | P60174 |
| 2215 | WAKQGVLLLN | *Campylobacter jejuni, Campylobacter jejuni, Campylobacter jejuni, Campylobacter lari* | Q5HX80, Q9PJ40, A1VXG9, A8FJP1, B9KEK7 | P13051 |
| 2216 | WAKQGVLLLNAVLTV | *Leuconostoc citreum* | B1MXY4 | P13051 |
| 2217 | WCISRQLWWGH | *Campylobacter jejuni, Campylobacter jejuni, Neisseria meningitidis, Neisseria gonorrhoeae, Neisseria meningitidis* | Q5HV17, Q9PPE4, Q9JX22, Q5F5W0, Q9K1H7 | P26640 |
| 2218 | WCISRQLWWGHRIP | *Helicobacter hepaticus* | Q7VHN2 | P26640 |
| 2219 | WCISRQLWWGHRIPA | *Bacillus cereus, Bacillus cereus, Bacillus cereus, Bacillus anthracis, Bacillus thuringiensis, Stenotrophomonas maltophilia, Stenotrophomonas maltophilia* | Q817R6, Q633Y6, Q72ZW8, Q81LD3, Q6HD68, B2FMS2, B4SJ70 | P26640 |
| 2220 | WCISRQLWWGHRIPAY | *Porphyromonas gingivalis, Porphyromonas gingivalis* | B2RK53, Q7MVD7 | P26640 |
| 2221 | WCISRQLWWGHRIPAYF | *Parabacteroides distasonis, Bacteroides fragilis, Bacteroides fragilis, Bacteroides thetaiotaomicron, Bacteroides vulgatus* | A6LIG7, Q64XH6, Q5LGN1, Q89ZM4, A6L3G7 | P26640 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2222 | WDLRKTQPY | *Propionibacterium acnes* | Q6A6G1 | O75306 |
| 2223 | WDWVGGRYSLWS | *Acinetobacter baumannii, Acinetobacter baumannii, Acinetobacter baumannii, Acinetobacter baumannii, Acinetobacter baumannii* | A3M0W5, B2IQ56, B0VMS2, B7H2H4, B0V6J2 | P06744 |
| 2224 | WDWVGGRYSLWSAIGL | *Pseudomonas mendocina, Pseudomonas putida, Pseudomonas putida, Pseudomonas putida, Pseudomonas putida, Pseudomonas putida, Pseudomonas entomophila, Pseudomonas stutzeri, Pseudomonas fluorescens, Pseudomonas fluorescens, Pseudomonas fluorescens, Pseudomonas aeruginosa, Pseudomonas aeruginosa, Pseudomonas aeruginosa, Pseudomonas aeruginosa, Pseudomonas fluorescens, Pseudomonas savastanoi, Pseudomonas syringae, Pseudomonas syringae* | A4XYC6, B0KHW6, B1J2C0, Q88DW7, A5W976, Q88LW9, Q1I4P0, A4VPM9, Q3K6Q4, Q4K5Y1, C3K249, Q9HV67, B7V1E4, Q02FU0, A6VCI8, Q84814, Q48N88, Q4ZY88, Q88807 | P06744 |
| 2225 | WDYAHCLPYF | *Staphylococcus xylosus, Staphylococcus saprophyticus* | Q9X2M2, Q4A0Q1 | Q8NE62 |
| 2226 | WIIDPIDGT | *Bacillus subtilis, Corynebacterium glutamicum* | P29218 Q45499, Q8NS80 | |
| 2227 | WKKNGWKTS | *Clostridium thermocellum* | A3DD79 | O60930 |
| 2228 | WLEVLGCGV | *Campylobacter lari* | B9KD77 | O95363 |
| 2229 | WLFDCGEGTQ | *Citrobacter koseri, Enterobacter* sp., *Enterococcus faecalis, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Streptococcus suis, Streptococcus suis, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae, Streptococcus pneumoniae* | A8ADW5, A4WCQ3, Q834G2, B7MXV1, B7NNU8, A1ADC0, Q1R9E5, Q8FFK8, B7MG36, Q0TFH3, B7N5N4, B617L2, A8A2D6, B1IXR8, P0A8V0, C4ZUB1, B7UFT1, B7M5V1, B7LAT4, A7ZP87, Q8XCZ0, B5XNW7, A6TBW1, A4WZ0, A4W299, C1CQF2, C1CJE0, B2IMY3, B1IAL2, C1C636, C1CD41, Q8DQN1, Q97RW2, B8ZMQ6, Q04LL3, B5E2R6 | Q9H777 |
| 2230 | WLHVDAAWGG | *Haemophilus influenzae* | P71362 | Q9Y600 |
| 2231 | WLTGLSGAGK | *Pseudomonas aeruginosa* | P57702 | Q43252 |
| 2232 | WNDMNEPSVFN | *Bacillus thermoamyloliquefaciens* | Q9F234 | Q14697 |
| 2233 | WPMTFGLACCA | *Geobacter uraniireducens, Geobacter bemidjiensis, Geobacter daltonii, Geobacter* sp., *Geobacter sulfurreducens, Geobacter metallireducens, Geobacter lovleyi* | A5G9B8, B5EFG2, B9LZL8, C6E8N4, Q74GA7, Q39QA8, B3E9W8 | O75251 |
| 2234 | WPMTFGLACCAVEMMH | *Stenotrophomonas maltophilia, Stenotrophomonas maltophilia* | B2FNX8, B45QT5 | O75251 |
| 2235 | WQTGSGTQTNMN | *Helicobacter pylori, Helicobacter pylori* | Q9ZJQ9, O25883 | P07954 |
| 2236 | WRLNERHYG | *Lactobacillus sakei, Lactobacillus sakei, Fusobacterium nucleatum, Bifidobacterium longum, Bifidobacterium longum, Bifidobacterium longum, Corynebacterium jeikeium, Corynebacterium diphtheriae, Corynebacterium kropnstedtii,* | Q38Z74, Q38ZH8, Q8RFG9, B3DQI6, B7GUR7, P59159, Q4JSW4, Q6NJL2, C4LLD4, Q8FSH0, A40B41, Q8NTA5, A1VAI9, Q727C0, Q839H4, Q74CR0, | P15259 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Corynebacterium efficiens, Corynebacterium glutamicum, Corynebacterium glutamicum, Desulfovibrio vulgaris, Desulfovibrio vulgaris, Enterococcus faecalis, Geobacter sulfurreducens, Geobacter sp., Geobacter bemidjiensis, Haemophilus parasuis, Haemophilus influenzae, Haemophilus influenzae, Haemophilus influenzae, Haemophilus influenzae, Haemophilus somnus, Haemophilus ducreyi, Listeria innocua, Listeria welshimeri, Listeria monocytogenes, Listeria monocytogenes, Listeria monocytogenes, Listeria monocytogenes, Propionibacterium acnes, Staphylococcus haemolyticus, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptococcus pyogenes, Streptomyces griseus, Streptomyces coelicolor, Streptomyces avermitilis* | C6E639, B5EC38, B8F5J4, P44865, Q40ME2, A5UDW8, A5UHR1, Q0I4D8, Q7VL28, Q929G8, A0AKV8, B8DFA5, Q8Y571, Q71XG0, C1KXG0, Q6AAU8, Q4L8T0, A2RDV4, P0DD06, Q1JAX0, B5XM69, Q1JL20, Q1JG44, P65711, P0DD07, Q5X1388, Q1J5W1, Q485P2, Q99Z29, B1VS80, P33158, Q82GB8 | |
| 2237 | WRLNERHYGGL | *Desulfovibrio maeticus, Desulfovibrio vulgaris, Staphylococcus saprophyticus, Staphylococcus carnosus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Stenotrophomonas maltophilia, Stenotrophomonas maltophilia* | C4XIQ5, B8DLN4, Q49ZZ2, B9DL85, Q8CN61, Q5HLI0, Q6GE17, A5IVJ6, A8YYG4, Q5HDD9, P65709, A6U4E6, Q2FE81, A7X656, Q6G605, A6QJQ5, Q2FVK8, P65708, P99153, Q2YVZ6, B2FHH6, B4SPL6 | P15259 |
| 2238 | WRLNERHYGGLT G | *Streptococcus agalactiae, Streptococcus agalactiae, Streptococcus agalactiae, Streptococcus mutans, Streptococcus uberis, Streptococcus equi, Streptococcus equi, Streptococcus equi* | Q3K1U2, Q8E643, Q8E0G9, P59161, B9DUS6, B4U1Y5, C0MCW5, C0M8R8 | P15259 |
| 2239 | WRLNERHYGGLT GLNKAE | *Streptococcus suis* | A4W369 | P15259 |
| 2240 | WRLNERHYGGLT GLNKAETAA | *Sphingomonas wittichii* | A5VB15 | P15259 |
| 2241 | WSLLDNFEW | *Clostridium thermocellum* | P26208 | Q9H227 |
| 2242 | WSSCNIFSTQD | *Pseudomonas aeruginosa, Pseudomonas aeruginosa, Pseudomonas aeruginosa, Pseudomonas stutzeri, Pseudomonas mendocina* | Q9I685, B7V419, Q02TY0, A4VRF7, A4XPF3 | P23526 |
| 2243 | WTTTPWTLP | *Acinetobacter baylyi, Aeromonas hydrophila, Aeromonas salmonicida,* | Q6FG02, A0KG39, A4S1X5, A8E562, | P41252 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Arcobacter butzleri, Bacillus cereus, Bacillus cereus, Bacillus thuringiensis, Bacillus thuringiensis, Bacillus anthracis, Bacillus cereus, Bacillus thuringiensis, Bacillus cereus, Bacillus cereus, Bacillus cereus, Bacillus cereus, Bacillus cereus, Bacillus cereus, Bacillus cereus, Bacillus cereus, Bacillus cereus, Bacillus cereus, Bacillus cereus, Bacillus anthracis, Bacillus anthracis, Bacillus anthracis, Bacillus weihenstephanensis, Bacillus cytotoxicus, Desulfitobacterium hafniense, Desulfitobacterium hafniense, Fusobacterium nucleatum, Campylobacter curvus, Campylobacter concisus, Citrobacter koseri, Desulfovibrio vulgaris, Desulfovibrio vulgaris, Desulfovibrio vulgaris, Desulfovibrio desulfuricans, Edwardsiella ictaluri, Enterococcus faecalis, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Helicobacter hepaticus, Klebsiella pneumoniae, Neisseria meningitidis, Neisseria meningitidis, Neisseria gonorrhoeae, Neisseria meningitidis, Neisseria meningitidis, Neisseria gonorrhoeae, Proteus mirabilis, Staphylococcus aureus, Stenotrophomonas maltophilia, Stenotrophomonas maltophilia* | Q81E30, Q739A1, A0RDG3, Q6HJF2, Q81R75, Q63BZ8, Q6HER9, C1EPQ9, B7JJY2, Q636D1, B7H6N1, Q819R4, Q732H4, B9IVX2, B7HLM9, B7IUQ5, C3L730, C3P665, Q81WE4, A9VTD5, A7GRM0, B8FT35, Q24TH1, Q8RH47, A7GX26, A8Z6P6, A8ALT6, Q72AR5, A1VCU3, B8DPD6, B8J3R3, C5B7M4, Q836V1, Q0TLW5, B7UI71, Q1RGH6, Q8FLB7, A1A774, B7MNN1, B7MAE6, B1LFV6, B7NHD0, B7N7Q0, B1IRE9, B7LVN2, A7ZHB5, B6HZ21, P00956, B1XBF1, C4ZPV2, B7M0C2, B7L4E8, B5YYB8, Q8XA49, A7ZVX4, Q7VGX8, B5Y235, A9M1J7, Q9JVY4, Q5FAF5, A1KS62, Q9JXY7, B4RPY6, B4F2T5, P41368, B4SP18, B2FTJ0 | |
| 2244 | WTTTPWTLPSN | *Haemophilus somnus, Haemophilus parasuis, Staphylococcus saprophyticus, Staphylococcus carnosus* | Q0I1V8, B8F5E2, Q49WX5, B9DPP7 | P41252 |
| 2245 | WVEPELRGV | *Rhizobium leguminosarum* | Q1MHI4 | O14782 |
| 2246 | WVGGRYSLWS | *Acinetobacter baumannii* | B7IBR9 | P06744 |
| 2247 | WVLGEHGDSS | *Lactobacillus delbrueckii* | Q04CN9 | P00338 |
| 2248 | WVQIFENKGA | *Haemophilus influenzae* | P31764 | P07902 |
| 2249 | WYDNEFGYS | *Pseudomonas aeruginosa* | Q02PG5 | P04406 |
| 2250 | YAEALREVSAA | *ptoclostridium difficile* | Q184E3 | P15313 |
| 2251 | YAEALREVSAAR | *Fusobacterium nucleatum, Clostridium thermocellum* | Q8RI79, A3DHP1 | P15313 |
| 2252 | YARGAQDMK | *Campylobacter fetus* | A0RNM0 | Q03154 |
| 2253 | YATRDLAAA | *Clostridium perfringens, Clostridium beijerinckii, Clostridium botulinum, Clostridium botulinum, Clostridium acetobutylicum* | Q8XJU2, A6L573, B2UW74, B1KYT1, Q97K78 | Q5T160 |
| 2254 | YATRDLAAAI | *Clostridium kluyveri, Clostridium kluyveri, Clostridium botulinum, Clostridium botulinum, Clostridium botulinum, Clostridium botulinum, Clostridium botulinum, Clostridium botulinum* | A5N8F9, B9E1W5, B1I1E6, A7GCB9, C1FK28, C3KSZ0, A5IQR5, A7FSW7 | Q5T160 |
| 2255 | YCGFDPTADS | *Bacillus caldotenax, Bacillus thuringiensis, Bacillus cereus, Bacillus anthracis, Bacillus cereus, Bacillus cereus, Desulfitobacterium hafniense, Desulfitobacterium hafniense, Citrobacter koseri, Enterobacter sp., Escherichia fergusonii, Escherichia* | P04077, Q6HCM0, Q633D2, Q81KS9, Q72Z73, Q817A2, Q251G4, B8G0N6, A8AH18, A4W9W0, B7LQN3, B1LEP9, B6IB76, B7NB91, | Q9Y2Z4 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Klebsiella pneumoniae, Klebsiella pneumoniae, Neisseria meningitidis, Neisseria meningitidis, Neisseria meningitidis, Neisseria meningitidis, Neisseria gonorrhoeae, Neisseria gonorrhoeae | P0AGJ9, B1IQB7, C4ZYA0, A8A010, B1XFU9, B7NTZ5, B5Z471, P0AGK0, A7ZM99, B7M0J4, Q8FH88, B7MVB5, B7L5J0, B7M9Z1, B7URX8, Q1RBF8, A1ABI2, B5XWP0, A6T9Y5, A9M1J5, A1KS60, Q9JXY5, Q9JVY6, B4RP13, Q5FAF7 | |
| 2256 | YCIVPFTRG | Staphylococcus haemolyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus saprophyticus | Q4L5Z6, Q8CSS3, Q5HPP8, Q6GHE3, Q2YXS2, Q7A110, Q6G951, Q7A5W3, Q99UI1, A5ISH6, A6U1B1, A7X1T3, A8Z1W3, Q2FZ02, A6QGJ1, Q5HGD9, Q2FHE6, Q49X85 | Q965Z6 |
| 2257 | YCLGPTHEE | Desulfovibrio alaskensis, Desulfovibrio salexigens, Desulfovibrio vulgaris, Desulfovibrio vulgaris, Desulfovibrio vulgaris | Q30Z93, C6BYX7, A1VE74, Q72CD8, B8DNM5 | Q7L3T8 |
| 2258 | YCTGGIRCE | Bacillus clausii, Bacillus cereus, Bacillus cereus, Bacillus weihenstephanensis, Bacillus cereus, Bacillus thuringiensis, Bacillus cytotoxicus, Bacillus cereus, Bacillus cereus, Bacillus cereus, Bacillus anthracis, Bacillus anthracis, Bacillus cereus, Bacillus anthracis, Bacillus thuringiensis, Bacillus cereus, Bacillus cereus, Bacillus licheniformis, Corynebacterium diphtheriae, Corynebacterium efficiens, Corynebacterium aurimucosum, Corynebacterium glutamicum, Corynebacterium glutamicum, Corynebacterium kropnstedtii, Enterococcus faecalis, Kocuria rhizophila, Listeria monocytogenes, Listeria monocytogenes, Listeria monocytogenes, Listeria monocytogenes, Listeria welshimeri, Listeria innocua, Staphylococcus saprophyticus, Staphylococcus carnosus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, | Q5WEM1, B9IX93, B7HMP7, A9VQI6, C1EQF9, A0RCP2, A7GNS3, Q73A25, B7HIR1, Q81F03, C3L6L9, C3P778, B7JJJ3, Q81S00, Q6HK75, Q63CS8, B7IS63, Q65EW5, Q6NEH3, Q8FLN8, C3PKD8, Q8NLF0, A4QI35, C4LG97, Q837T2, B2GKC1, Q8Y7A4, B8DFU3, Q71ZT6, C1L2U0, A0AII6, Q92BX1, Q4A0W6, B9DJ55, A6U574, A5IW36, P67326, A7X781, P67327, Q5HCK8, Q8NUH3, Q6G5Y5, Q6GDB5, Q2YZA3, Q2FUS7, A8Z5J0, Q2FDH2, A6QKH7, Q4L9R7, Q8CTV8, Q5HKM8 | Q5T7W7 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | *Staphylococcus aureus, Staphylococcus aureus, Staphylococcus haemolyticus, Staphylococcus epidermidis, Staphylococcus epidermidis* | | |
| 2259 | YDLTSKPPGT | *Eubacterium rectale, Eubacterium eligens* | C4ZCQ4, C4Z3X1 | P49915 |
| 2260 | YDLVLNGNE | *Desulfovibrio alaskensis* | Q317R3 | Q6PI48 |
| 2261 | YGITTGFGKF | *Bacillus methylotrophicus, Bacillus halodurans* | A7ZAE4, Q9KBE6 | P42357 |
| 2262 | YGITTGFGKFA | *Fusobacterium nucleatum* | Q8RFC2 | P42357 |
| 2263 | YGPPGTGKT | *Micrococcus luteus* | C5CBU4 | Q6PL18 |
| 2264 | YGPPGVGKT | *Bacillus subtilis* | P42425 | P36776 |
| 2265 | YGPPGVGKTS | *Parabacteroides distasonis, Campylobacter jejuni, Porphyromonas gingivalis* | A6LD45, O69300, B2RI16 | P36776 |
| 2266 | YICGEETALI | *Escherichia coli* | P31979 | P49821 |
| 2267 | YIEAHGTGT | *Bacillus subtilis, Bacillus subtilis* | Q05470, O31782 | P49327 |
| 2268 | YIGVLIDDL | *Bacillus cytotoxicus, Bacillus cereus, Bacillus cereus, Bacillus weihenstephanensis, Bacillus thuringiensis, Bacillus cereus, Bacillus anthracis, Bacillus thuringiensis, Lactobacillus gasseri, Lactobacillus johnsonii, Listeria welshimeri, Listeria monocytogenes, Listeria monocytogenes, Listeria innocua, Staphylococcus haemolyticus, Staphylococcus saprophyticus, Staphylococcus epidermidis, Staphylococcus epidermidis, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus, Staphylococcus aureus* | A7GVP6, Q814F7, Q72WU4, A9VTL9, Q6HAF3, Q63069, Q81JH3, A0RLR1, Q040F4, Q74H95, A0AMD1, Q8Y3M5, Q71VV1, Q926U8, Q4L2Z3, Q49UI5, Q8CMN6, Q5HS35, Q2YZB9, P64231, Q6G5W5, Q6GD93, P64230, P64229, A7X7A7, A5IW06, A6U594, A8YYS0, A6QKK1, Q5HCI4, Q2FUQ3, Q2FDE9 | Q9Y2Z2 |
| 2269 | YINSPGGWT | *Arcobacter butzleri, Campylobacter lari, Campylobacter hominis, Rhizobium loti, Rhizobium loti* | A8EVH5, B9KDZ6, A7HZE8, Q982V6, Q98M38 | Q16740 |
| 2270 | YINSPGGWTAG | *Rhizobium etli, Rhizobium leguminosarum, Rhizobium meliloti* | Q2K9U7, Q1MIM7, P58278 | Q16740 |
| 2271 | YINSPGGWTAGLAIYDTM | *Haemophilus ducreyi* | Q7VP78 | Q16740 |
| 2272 | YITPVPGGVGPMT | *Bacteroides vulgatus, Parabacteroides distasonis, Campylobacter jejuni, Campylobacter jejuni, Campylobacter jejuni, Porphyromonas gingivalis* | A6L2G2, A6L8J2, Q0PA35, A8FLR4, A1VZJ8, Q5HUU1, Q7MVE9 | P13995 |
| 2273 | YLDLYLIHWP | *Bacillus subtilis, Bacillus subtilis* | O34678, O32210 | Q96JD6 |
| 2274 | YLRPETAQGIF | *Eubacterium rectale, Bifidobacterium longum, Clostridium kluyveri, Clostridium kluyveri, Clostridium acetobutylicum, Clostridium perfringens, Clostridium phytofermentans, Clostridium eijerinckii, Clostridium cellulolyticum, Clostridium thermocellum, Corynebacterium efficiens, Corynebacterium glutamicum, Eubacterium eligens,* | C4ZAV7, Q8G7W9, A5N4L2, B9DY74, Q97EB8, Q8XHL9, A9KJ36, A6LPL6, B8I2Z6, A3DF15, Q8FNG6, Q8NNC6, C4Z1I4, Q6A964, Q9L2H9, Q82BR9 | P41250 |

TABLE 1-continued

Gut bacterial species carrying candidate mimic peptide, amino acids sequence of related
mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2275 | YLVMEYVPG | *Propionibacterium acnes, Streptomyces coelicolor, Streptomyces avermitilis Bacillus anthracis* | Q81WH6 | P22612 |
| 2276 | YNKDLQEDKE | *Lactobacillus plantarum, Lactobacillus fermentum, Lactobacillus salivarius, Listeria monocytogenes, Listeria monocytogenes, Listeria monocytogenes, Listeria monocytogenes, Listeria innocua, Listeria welshimeri, Streptococcus mutans, Streptococcus uberis, Streptococcus thermophilus, Streptococcus thermophilus, Streptococcus thermophilus, Streptococcus sanguinis, Streptococcus gordonii, Streptococcus pneumoniae, Streptococcus pneumoniae, Streptococcus pneumoniae, Streptococcus pneumoniae, Streptococcus pneumoniae, Streptococcus agalactiae, Streptococcus agalactiae, Streptococcus agalactiae* | P59617, B2GE78, Q1WV66, C1KX44, Q71XS3, B8DH27, Q8Y5H1, Q929S8, A0AKJ8, Q8DVX5, B9DW8, Q03IP9, Q5M2K3, Q5LXZ9, A3CQQ3, A8AUN7, C1CAC7, C1CBS9, Q8DRI4, B1I815, Q04MW6, Q8E271, Q3K3Q3, Q8E7N0 | P04424 |
| 2277 | YPLNPNGSP | *Ralstonia solanacearum* | Q8XYN6 | O15067 |
| 2278 | YQDQKPGTSGLRK | *Rhizobium radiobacter* | P39671 | P36871 |
| 2279 | YQIYPRSFKD | *Streptococcus dysgalactiae* | Q59905 | Q07837 |
| 2280 | YQIYPRSFKDSN | *Bacillus subtilis* | O05242 | Q07837 |
| 2281 | YQRLEFLGD | *Leuconostoc mesenteroides, Leuconostoc citreum, Rhizobium sp., Rhizobium meliloti* | Q03VW5, B1N016, C3M854, Q92R47 | Q9UPY3 |
| 2282 | YQWYLDLRR | *Lactobacillus sakei* | Q38X65 | Q96159 |
| 2283 | YRDDGLLVW | *Pseudomonas aeruginosa, Pseudomonas aeruginosa* | Q9I4G8, Q8RNT4 | P09917 |
| 2284 | YRIDHYLGKE | *Escherichia coli, Escherichia coli, Escherichia coli* | O8XCJ6, P0AC53, P0AC54 | P11413 |
| 2285 | YRKLALKYHPD | *Helicobacter pylori, Helicobacter pylori* | O25890, Q9ZJQ2 | Q8WW22 |
| 2286 | YRLALQTREQHIRR | *Ralstonia pickettii, Ralstonia solanacearum* | B2UG82, Q8XU98 | P23378 |
| 2287 | YRLALQTREQHIRRDKATSNICTAQALLANMA | *Rhizobium loti* | Q98LT6 | P23378 |
| 2288 | YRQRYLDLI | *Lactobacillus plantarum, Lactobacillus fermentum, Lactobacillus sakei, Pediococcus ntosaceus* | Q88Z28, B2GA78, Q38V83, Q03E09 | Q15046 |
| 2289 | YSALKKDGQ | *Pseudomonas aeruginosa, Pseudomonas aeruginosa, Pseudomonas aeruginosa, Pseudomonas mendocina* | A6VCJ9, P72154, Q02FT0, A4XYD8 | Q8WWH5 |
| 2290 | YSAVNQGHCHPKI | *Bacillus halodurans* | Q9K5Z2 | P04181 |
| 2291 | YTAIEAPKGE | *Geobacter uraniireducens* | A5GCZ4 | O75306 |
| 2292 | YTHFTSPIRR | *Bacillus subtilis, Helicobacter pylori, Helicobacter pylori* | O32231, P56123, Q9ZJX9 | Q8IYB7 |
| 2293 | YTPYQPEVSQGRLE | *Citrobacter koseri, Edwardsiella ictaluri, Enterobacter sp., Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli* | A8APB1, C5BAT0, A4WE55, Q1R7C8, B7MZ55, B7MM89, B7UHV1, Q0TDU9, B7LYG7, A7ZR12, Q8FE67, B7N7E6, B7NHW4, B1LDA3, A1AF92, Q8XD33, B5YQ95, B7LPB7, P33195, C5A0H5, B1XEJ0, B61736, A8A444, B7LF89, B1IT99 | P23378 |
| 2294 | YTPYQPEVSQGRLESLLN | *Klebsiella pneumoniae, Klebsiella pneumoniae, Proteus mirabilis* | A6TDR5, B5XUD5, B4F0N7 | P23378 |
| 2295 | YTRREPLGVC | *Rhizobium meliloti* | Q92YD2 | P49189 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| 2296 | YTSGSTGKPKGV | Aneurinibacillus migulanus, Bacillus subtilis, Bacillus subtilis, Bacillus subtilis, Bacillus subtilis, Bacillus subtilis | P00063, P39847, Q9R9I9, Q04747, Q9R9J0, P40806 | Q9NR19 |
| 2297 | YTSGSTGMPKG | Bacillus licheniformis, Bacillus subtilis | O68008, P94459 | Q9NUB1 |
| 2298 | YTSGSTGRPKGV | Bacillus subtilis, Streptomyces niveus | P45745, Q9L9G0 | O60488 |
| 2299 | YTSGTTGLPKG | Pseudomonas sp. | A5JTM6 | Q9H6R3 |
| 2300 | YTSGTTGNPKG | Aneurinibacillus migulanus | P00061 | Q96GR2 |
| 2301 | YTSGTTGNPKGV | Pseudomonas oleovorans | Q00594 | Q96GR2 |
| 2302 | YTSGTTGNPKGVM | Bacillus licheniformis | Q68007 | Q96GR2 |
| 2303 | YTSVLKRAI | Citrobacter koseri, Edwardsiella ictaluri, Enterobacter sp., Escherichia coli, Escherichia coli, Escherichia coli, Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Geobacter metallireducens, Klebsiella pneumoniae, Klebsiella pneumoniae, Proteus mirabilis, Streptococcus thermophilus, Streptococcus thermophilus, Streptococcus thermophilus, Streptococcus pneumoniae, Streptococcus pneumoniae, Streptococcus pneumoniae, Streptococcus pneumoniae, Streptococcus pneumoniae, Streptococcus sanguinis, Streptococcus pneumoniae, Streptococcus pneumoniae, Streptococcus pneumoniae, Streptococcus gordonii, Uncultured termite | A8AJ40, C5BEL3, A4W897, P62708, B7N9Z7, B7NNH7, B1LM46, B7M6B8, P62707, B7LK04, B617Q9, Q0TJU6, B1X786, B5YRF2, B7MPN9, A7ZY11, B1IXY1, B7LAF6, P62709, C4ZXS6, A1A8Z8, B7MGL2, B7ULM8, A7ZJD0, Q39V40, B5XZB2, A6T6I3, B4EST0, Q03KA9, Q8VVB5, Q5LZF1, C1C8P5, C1CFM7, P0A3Y4, P0A3Y3, B1I720, B5E706, Q04JB4, A3CLS0, C1CLZ5, B8ZM52, C1CSS1, B2IRR1, A8AW46, B1GZZ1 | P15259 |
| 2304 | YTSVLKRAIRTL | Clostridium acetobutylicum | Q97FJ6 | P15259 |
| 2305 | YTSVLKRAIRTLW | Bacillus cereus, Bacillus cereus, Bacillus cereus, Bacillus cereus, Bacillus cereus, Bacillus cereus, Bacillus anthracis, Bacillus anthracis, Bacillus anthracis, Bacillus cereus, Bacillus cereus, Bacillus thuringiensis, Bacillus cereus, Bacillus thuringiensis, Bacillus cytotoxicus, Bacillus weihenstephanensis, Clostridium beijerinckii, Ralstonia solanacearum | Q737X5, Q81DD2, B7IX37, B9J102, B7H546, B7H7P4, Q6KSL4, C3PAW8, C3LIE5, B7JPK2, Q63692, A0RE96, C1EUQ5, Q6HIL9, A7GPN5, A9VFW9, A6LUA1, Q8Y2I3 | P15259 |
| 2306 | YVEGESLLM | Pseudomonas putida, Pseudomonas entomophila, Pseudomonas putida, Pseudomonas putida, Pseudomonas putida | B1JDR3, Q1IEJ2, Q88PK8, A5VYS4, B0KPH6 | Q9Y697 |
| 2307 | YVGCGERGNEM | Enterococcus faecalis | Q834X9 | P38606 |
| 2308 | YVHRIGRTGR | Aeromonas hydrophila, Aeromonas salmonicida, Citrobacter koseri, Enterobacter sp., Escherichia coli, Escherichia coli, Escherichia coli, Escherichia fergusonii, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, Escherichia coli, | A0KEG9, A4STJ7, A8ACT3, A4WG30, P25888, B5YY28, Q8XAT4, B7LU75, B7NTG2, P0A8J8, Q1R4F9, B6I4B6, C4ZZ48, B1IWC0, Q0TAU3, P0A8J9, A1AHV0, A8A6N4, B1X9Z4, B7M5C7, B7MR01, B7L8B6, A7ZTY2, B7MGJ1, B7UMN5, B7NF85, | Q9UJV9 |

TABLE 1-continued

Gut bacterial species carrying candidate mimic peptide, amino acids sequence of related mimic peptide and Uniprot ID of bacterial and human protein containing each mimic peptide

| SEQ ID NO: | Candidate mimic peptide | Gut Bacterial species carrying candidate mimic peptide | Uniprot ID of bacterial protein containing mimic peptide | Uniprot ID of human protein containing mimic peptide |
|---|---|---|---|---|
| | | Escherichia coli, Escherichia coli, Escherichia coli, Escherichia coli, Escherichia coli, Haemophilus somnus, Haemophilus influenzae, Haemophilus influenzae, Haemophilus influenzae, Haemophilus influenzae, Klebsiella pneumoniae, Klebsiella pneumoniae, Klebsiella pneumoniae, Proteus mirabilis | B1LLV3, Q8XA87, P0A9P6, P0A9P7, Q0I1X0, P44586, A5UI36, P44922, A5UDI1, A6TGG9, B5XYY9, P33906, B4F1V3 | |
| 2309 | YVHRVGRTARAG | Bacillus subtilis | P54475 | Q8N8A6 |
| 2310 | YVNDAFGTAHRAH | Bacteroides thetaiotaomicron, Porphyromonas gingivalis | Q8A753, Q7MU77 | P07205 |
| 2311 | YVYIIYGMY | Clostridium perfringens, Clostridium perfringens, Clostridium perfringens | Q8XHA9, Q0SPY0, Q0TM75 | P29372 |
| 2312 | YWHFVDWW | Corynebacterium diphtheriae, Corynebacterium glutamicum, Corynebacterium efficiens, Streptomyces coelicolor, Streptomyces avermitilis | Q6NGA0, Q9AEL8, Q8FN09, Q9X809, Q82AK5 | P00414 |
| 2313 | YWLSGLTCTEQNFI | Haemophilus influenzae | P44556 | P10768 |

TABLE 2

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| CVOZ01000027.1 | Bacteroides thetaiotaomicron | 37953 | 39176 |
| CVOZ01000054.1 | Bacteroides thetaiotaomicron | 11293 | 10091 |
| CVOZ01000070.1 | Bacteroides thetaiotaomicron | 209 | 1357 |
| JGCP01002329.1 | Bacteroides fragilis | 4469 | 5122 |
| JGCP01002329.1 | Bacteroides fragilis | 3779 | 5098 |
| NC_000913.3 | Escherichia coli | 4581453 | 4580197 |
| NC_009614.1 | Bacteroides vulgatus | 4257974 | 4256682 |
| NC_009614.1 | Bacteroides vulgatus | 4556425 | 4555544 |
| NC_012781.1 | Eubacterium rectale | 2288771 | 2288262 |
| NC_012781.1 | Eubacterium rectale | 784939 | 786126 |
| NC_012781.1 | Eubacterium rectale | 1283259 | 1283786 |
| NZ_AAVM02000005.1 | Bacteroides caccae | 114685 | 114182 |
| NZ_ACEP01000037.1 | Eubacterium hallii | 7170 | 8357 |
| NZ_DS264584.1 | Bacteroides ovatus | 814601 | 813570 |
| NZ_DS544184.1 | Anaerotruncus colihominis | 120271 | 119024 |
| NZ_DS544185.1 | Anaerotruncus colihominis | 210646 | 210155 |
| NZ_DS981517.1 | Clostridium sporogenes | 1624655 | 1624691 |
| NZ_DS981517.1 | Clostridium sporogenes | 2067986 | 2066751 |
| NZ_DS990240.1 | Bifidobacterium longum | 215669 | 216163 |
| NZ_DS995528.1 | Bacteroides dorei | 145200 | 143932 |
| NZ_DS995531.1 | Bacteroides dorei | 422777 | 421590 |
| NZ_DS996451.1 | Parabacteroides johnsonii | 204827 | 205366 |
| NZ_DS996841.1 | Holdemanella biformis | 520281 | 520754 |
| NZ_DS996921.1 | Bacteroides pectinophilus | 1435212 | 1434652 |
| NZ_GG667612.1 | Hungatella hathewayi | 20416 | 21654 |
| NZ_GG703853.1 | Prevotella copri | 461595 | 462476 |
| NZ_GG739634.1 | Edwardsiella tarda | 123662 | 122379 |
| NZ_JH370372.1 | Alistipes indistinctus | 576953 | 575652 |
| NZ_JH724294.1 | Bacteroides xylanisolvens | 756855 | 758042 |
| NZ_MTWC01000003.1 | Clostridioides difficile | 3445824 | 3444499 |
| NZ_MTWF01000021.1 | Clostridioides difficile | 518815 | 517457 |
| NZ_PPUH01000002.1 | Eggerthella lenta | 280904 | 279747 |
| NZ_PUEP01000005.1 | Bacteroides ovatus | 2631144 | 2632175 |
| NZ_PUEQ01000002.1 | Bacteroides caccae | 481569 | 481066 |
| QEKH01000037.1 | Victivallis vadensis | 16258 | 17517 |
| QEKH01000037.1 | Victivallis vadensis | 16252 | 16887 |
| CVOZ01000028.1 | Bacteroides thetaiotaomicron | 3250 | 2549 |
| CVOZ01000054.1 | Bacteroides thetaiotaomicron | 13292 | 11376 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| JGCP01000504.1 | *Bacteroides fragilis* | 6097 | 5297 |
| JGCP01002329.1 | *Bacteroides fragilis* | 1730 | 3721 |
| NC_000913.3 | *Escherichia coli* | 4582670 | 4581897 |
| NC_009614.1 | *Bacteroides vulgatus* | 4260288 | 4258765 |
| NC_009614.1 | *Bacteroides vulgatus* | 4559064 | 4558243 |
| NC_009614.1 | *Bacteroides vulgatus* | 5131510 | 5130809 |
| NC_009614.1 | *Bacteroides vulgatus* | 4258359 | 4258033 |
| NC_010655.1 | *Akkermansia muciniphila* | 2326675 | 2325422 |
| NC_012781.1 | *Eubacterium rectale* | 1280802 | 1282049 |
| NC_012781.1 | *Eubacterium rectale* | 783803 | 784687 |
| NC_012781.1 | *Eubacterium rectale* | 2289989 | 2289360 |
| NZ_AAVM02000001.1 | *Bacteroides caccae* | 205035 | 205766 |
| NZ_AAVM02000001.1 | *Bacteroides caccae* | 203504 | 204244 |
| NZ_AAVM02000004.1 | *Bacteroides caccae* | 19818 | 20552 |
| NZ_AAVM02000004.1 | *Bacteroides caccae* | 18226 | 19026 |
| NZ_AAVM02000005.1 | *Bacteroides caccae* | 117790 | 117089 |
| NZ_AAVN02000002.1 | *Collinsella aerofaciens* | 214688 | 215971 |
| NZ_AAVN02000005.1 | *Collinsella aerofaciens* | 3193 | 3990 |
| NZ_ABJL02000008.1 | *Bacteroides intestinalis* | 2255438 | 2256781 |
| NZ_ACEP01000015.1 | *Eubacterium hallii* | 5220 | 6134 |
| NZ_ACEP01000037.1 | *Eubacterium hallii* | 5395 | 6828 |
| NZ_ACEP01000037.1 | *Eubacterium hallii* | 6874 | 7077 |
| NZ_ATFI01000008.1 | *Bacteroides cellulosilyticus* | 568907 | 569809 |
| NZ_ATFI01000010.1 | *Bacteroides cellulosilyticus* | 71257 | 72078 |
| NZ_ATFI01000012.1 | *Bacteroides cellulosilyticus* | 54384 | 55085 |
| NZ_CVOY01000006.1 | *Bacteroides thetaiotaomicron* | 52086 | 51364 |
| NZ_DS264518.1 | *Parabacteroides merdae* | 16658 | 15375 |
| NZ_DS264540.1 | *Parabacteroides merdae* | 361593 | 360295 |
| NZ_DS264579.1 | *Bacteroides ovatus* | 224414 | 223701 |
| NZ_DS264583.1 | *Bacteroides ovatus* | 46086 | 45352 |
| NZ_DS264583.1 | *Bacteroides ovatus* | 47678 | 46878 |
| NZ_DS264584.1 | *Bacteroides ovatus* | 815730 | 814999 |
| NZ_DS362241.1 | *Bacteroides uniformis* | 196137 | 195403 |
| NZ_DS362241.1 | *Bacteroides uniformis* | 197729 | 196929 |
| NZ_DS480690.1 | *Clostridium bolteae* | 323991 | 322990 |
| NZ_DS480691.1 | *Clostridium bolteae* | 78208 | 77450 |
| NZ_DS499657.1 | *Erysipelatoclostridium ramosum* | 178202 | 178987 |
| NZ_DS499711.1 | *Clostridium scindens* | 60639 | 59893 |
| NZ_DS499717.1 | *Clostridium scindens* | 8080 | 8883 |
| NZ_DS544184.1 | *Anaerotruncus colihominis* | 122241 | 120328 |
| NZ_DS544185.1 | *Anaerotruncus colihominis* | 208987 | 208256 |
| NZ_DS562851.1 | *Clostridium spiroforme* | 122136 | 120808 |
| NZ_DS607662.1 | *Providencia stuartii* | 136152 | 134944 |
| NZ_DS607663.1 | *Providencia stuartii* | 2255207 | 2254365 |
| NZ_DS981517.1 | *Clostridium sporogenes* | 2070130 | 2068076 |
| NZ_DS981517.1 | *Clostridium sporogenes* | 1625390 | 1626655 |
| NZ_DS990167.1 | *Ruminococcus lactaris* | 53930 | 53016 |
| NZ_DS990240.1 | *Bifidobacterium longum* | 218706 | 219962 |
| NZ_DS995528.1 | *Bacteroides dorei* | 147185 | 145257 |
| NZ_DS995531.1 | *Bacteroides dorei* | 416684 | 417385 |
| NZ_DS995533.1 | *Bacteroides dorei* | 155441 | 156262 |
| NZ_DS995537.1 | *Bacteroides dorei* | 1437808 | 1436660 |
| NZ_DS996451.1 | *Parabacteroides johnsonii* | 207952 | 208764 |
| NZ_DS996456.1 | *Parabacteroides johnsonii* | 108659 | 107847 |
| NZ_DS996456.1 | *Parabacteroides johnsonii* | 110251 | 109451 |
| NZ_DS996841.1 | *Holdemanella biformis* | 530223 | 529429 |
| NZ_DS996842.1 | *Holdemanella biformis* | 261013 | 259934 |
| NZ_DS996921.1 | *Bacteroides pectinophilus* | 1430841 | 1431722 |
| NZ_EQ973491.1 | *Bacteroides cellulosilyticus* | 1154297 | 1153236 |
| NZ_EQ973628.1 | *Bacteroides coprophilus* | 87118 | 88245 |
| NZ_EQ973632.1 | *Bacteroides coprophilus* | 313579 | 314352 |
| NZ_GG661996.1 | *Proteus penneri* | 1167486 | 1168580 |
| NZ_GG688317.1 | *Bacteroides finegoldii* | 348015 | 347215 |
| NZ_GG688317.1 | *Bacteroides finegoldii* | 346423 | 345689 |
| NZ_GG688319.1 | *Bacteroides finegoldii* | 253543 | 252737 |
| NZ_GG688335.1 | *Bacteroides finegoldii* | 35726 | 34782 |
| NZ_GG693680.1 | *Lactobacillus reuteri* | 26256 | 25393 |
| NZ_GG698591.1 | *Blautia hansenii* | 55695 | 54289 |
| NZ_GG703853.1 | *Prevotella copri* | 460179 | 461117 |
| NZ_GG703856.1 | *Prevotella copri* | 196695 | 195994 |
| NZ_GG704769.1 | *Subdoligranulum variabile* | 1915102 | 1914251 |
| NZ_GG704769.1 | *Subdoligranulum variabile* | 716466 | 715603 |
| NZ_GG704770.1 | *Subdoligranulum variabile* | 46083 | 47042 |
| NZ_GG704863.1 | *Enterobacter cancerogenus* | 307779 | 308621 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_GG705268.1 | *Providencia rettgeri* | 11845 | 12723 |
| NZ_GG729831.1 | *Bifidobacterium breve* | 488254 | 489387 |
| NZ_GG739634.1 | *Edwardsiella tarda* | 126001 | 124481 |
| NZ_JDUD01000001.1 | *Bifidobacterium breve* | 1961 | 828 |
| NZ_JH370372.1 | *Alistipes indistinctus* | 579365 | 577842 |
| NZ_JH724294.1 | *Bacteroides xylanisolvens* | 755593 | 756279 |
| NZ_KB946519.1 | *Enterococcus faecalis* | 1804247 | 1803225 |
| NZ_MTWC01000003.1 | *Clostridioides difficile* | 3447851 | 3445902 |
| NZ_MTWF01000021.1 | *Clostridioides difficile* | 520833 | 518884 |
| NZ_PPUH01000002.1 | *Eggerthella lenta* | 282952 | 281126 |
| NZ_PPUH01000003.1 | *Eggerthella lenta* | 250182 | 248503 |
| NZ_PUEM01000006.1 | *Clostridium bolteae* | 1494991 | 1494233 |
| NZ_PUEM01000006.1 | *Clostridium bolteae* | 4993617 | 4992616 |
| NZ_PUEO01000014.1 | *Bacteroides thetaiotaomicron* | 1484088 | 1484909 |
| NZ_PUEO01000014.1 | *Bacteroides thetaiotaomicron* | 1462828 | 1463529 |
| NZ_PUEP01000005.1 | *Bacteroides ovatus* | 2630015 | 2630746 |
| NZ_PUEP01000005.1 | *Bacteroides ovatus* | 458680 | 459414 |
| NZ_PUEP01000005.1 | *Bacteroides ovatus* | 457088 | 457888 |
| NZ_PUEP01000005.1 | *Bacteroides ovatus* | 4797484 | 4798197 |
| NZ_PUEQ01000002.1 | *Bacteroides caccae* | 484674 | 483973 |
| NZ_PUEQ01000003.1 | *Bacteroides caccae* | 2030655 | 2029921 |
| NZ_PUEQ01000003.1 | *Bacteroides caccae* | 2032247 | 2031447 |
| NZ_PUEQ01000003.1 | *Bacteroides caccae* | 3827059 | 3827790 |
| NZ_PUEQ01000003.1 | *Bacteroides caccae* | 3825528 | 3826268 |
| NZ_UFTH01000001.1 | *Bacteroides fragilis* | 4093184 | 4094062 |
| NZ_UFTH01000001.1 | *Bacteroides fragilis* | 3280562 | 3281596 |
| NZ_UFTH01000001.1 | *Bacteroides fragilis* | 1493809 | 1494609 |
| QEKH01000037.1 | *Victivallis vadensis* | 13374 | 15320 |
| QEKH01000048.1 | *Victivallis vadensis* | 3497 | 2508 |
| CVOZ01000035.1 | *Bacteroides thetaiotaomicron* | 106949 | 108160 |
| CVOZ01000043.1 | *Bacteroides thetaiotaomicron* | 27888 | 26839 |
| JGCP01002172.1 | *Bacteroides fragilis* | 2 | 874 |
| JGCP01002354.1 | *Bacteroides fragilis* | 7402 | 8451 |
| JGCP01002545.1 | *Bacteroides fragilis* | 3274 | 4485 |
| NC_000913.3 | *Escherichia coli* | 425011 | 426039 |
| NC_009614.1 | *Bacteroides vulgatus* | 486915 | 488129 |
| NC_009614.1 | *Bacteroides vulgatus* | 1587181 | 1588227 |
| NC_009615.1 | *Parabacteroides distasonis* | 4582216 | 4581011 |
| NC_009615.1 | *Parabacteroides distasonis* | 2819035 | 2817989 |
| NC_010655.1 | *Akkermansia muciniphila* | 843027 | 842053 |
| NC_012781.1 | *Eubacterium rectale* | 1870731 | 1869694 |
| NZ_AAVM02000002.1 | *Bacteroides caccae* | 264921 | 265970 |
| NZ_AAVM02000003.1 | *Bacteroides caccae* | 71289 | 70078 |
| NZ_AAVN02000005.1 | *Collinsella aerofaciens* | 180699 | 181904 |
| NZ_AAXA02000015.1 | *Dorea formicigenerans* | 155473 | 154451 |
| NZ_AAYG02000031.1 | *Ruminococcus gnavus* | 76269 | 75247 |
| NZ_ABJL02000001.1 | *Bacteroides intestinalis* | 248746 | 247526 |
| NZ_ABJL02000007.1 | *Bacteroides intestinalis* | 194759 | 193713 |
| NZ_ABXA01000019.1 | *Anaerococcus hydrogenalis* | 158102 | 157086 |
| NZ_ABXW01000004.1 | *Providencia alcalifaciens* | 121941 | 122987 |
| NZ_ACCL02000019.1 | *Marvinbryantia formatexigens* | 57650 | 56628 |
| NZ_ACEP01000009.1 | *Eubacterium hallii* | 16113 | 17132 |
| NZ_ATFI01000001.1 | *Bacteroides cellulosilyticus* | 1098277 | 1099323 |
| NZ_ATFI01000006.1 | *Bacteroides cellulosilyticus* | 233208 | 231988 |
| NZ_CVOY01000007.1 | *Bacteroides thetaiotaomicron* | 140399 | 141610 |
| NZ_CVOY01000046.1 | *Bacteroides thetaiotaomicron* | 28312 | 27263 |
| NZ_DS264284.1 | *Eubacterium ventriosum* | 217372 | 216347 |
| NZ_DS264382.1 | *Ruminococcus torques* | 70803 | 71837 |
| NZ_DS264476.1 | *Parabacteroides merdae* | 37736 | 38782 |
| NZ_DS264542.1 | *Parabacteroides merdae* | 311126 | 312331 |
| NZ_DS264579.1 | *Bacteroides ovatus* | 416778 | 417827 |
| NZ_DS264584.1 | *Bacteroides ovatus* | 16717 | 15506 |
| NZ_DS362235.1 | *Bacteroides uniformis* | 56952 | 57998 |
| NZ_DS362247.1 | *Bacteroides uniformis* | 304752 | 303532 |
| NZ_DS480669.1 | *Clostridium bolteae* | 257651 | 256632 |
| NZ_DS499656.1 | *Erysipelatoclostridium ramosum* | 69655 | 68633 |
| NZ_DS499674.1 | *Bacteroides stercoris* | 260486 | 259440 |
| NZ_DS499677.1 | *Bacteroides stercoris* | 230155 | 231375 |
| NZ_DS499718.1 | *Clostridium scindens* | 28492 | 29511 |
| NZ_DS544183.1 | *Anaerotruncus colihominis* | 144332 | 145372 |
| NZ_DS562852.1 | *Clostridium spiroforme* | 49724 | 48702 |
| NZ_DS607683.1 | *Providencia stuartii* | 179065 | 180096 |
| NZ_DS981517.1 | *Clostridium sporogenes* | 618670 | 619701 |
| NZ_DS990170.1 | *Ruminococcus lactaris* | 184161 | 183127 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_DS995508.1 | *Bacteroides eggerthii* | 169795 | 168575 |
| NZ_DS995511.1 | *Bacteroides eggerthii* | 462444 | 461398 |
| NZ_DS995528.1 | *Bacteroides dorei* | 148712 | 147498 |
| NZ_DS995534.1 | *Bacteroides dorei* | 439390 | 440436 |
| NZ_DS996452.1 | *Parabacteroides johnsonii* | 143947 | 142901 |
| NZ_DS996453.1 | *Parabacteroides johnsonii* | 157487 | 156282 |
| NZ_DS996921.1 | *Bacteroides pectinophilus* | 1049700 | 1050290 |
| NZ_DS996921.1 | *Bacteroides pectinophilus* | 1050286 | 1050726 |
| NZ_EQ973489.1 | *Bacteroides cellulosilyticus* | 174147 | 172927 |
| NZ_EQ973490.1 | *Bacteroides cellulosilyticus* | 1290447 | 1291493 |
| NZ_EQ973631.1 | *Bacteroides coprophilus* | 94724 | 93663 |
| NZ_EQ973650.1 | *Bacteroides coprophilus* | 219067 | 217853 |
| NZ_GG657592.1 | *Clostridium asparagiforme* | 3244881 | 3245795 |
| NZ_GG661996.1 | *Proteus penneri* | 808745 | 807888 |
| NZ_GG662010.1 | *Coprococcus comes* | 66418 | 65384 |
| NZ_GG667675.1 | *Hungatella hathewayi* | 10370 | 9345 |
| NZ_GG688318.1 | *Bacteroides finegoldii* | 209328 | 210539 |
| NZ_GG688332.1 | *Bacteroides finegoldii* | 112379 | 113428 |
| NZ_GG692710.1 | *Collinsella intestinalis* | 58740 | 59960 |
| NZ_GG692730.1 | *Roseburia intestinalis* | 17297 | 16278 |
| NZ_GG698588.1 | *Blautia hansenii* | 858259 | 857240 |
| NZ_GG703852.1 | *Prevotella copri* | 471774 | 470506 |
| NZ_GG703861.1 | *Prevotella copri* | 82450 | 83631 |
| NZ_GG704769.1 | *Subdoligranulum variabile* | 943449 | 944462 |
| NZ_GG704864.1 | *Enterobacter cancerogenus* | 124853 | 125881 |
| NZ_GG705265.1 | *Providencia rettgeri* | 180250 | 179204 |
| NZ_GG739633.1 | *Edwardsiella tarda* | 362637 | 363656 |
| NZ_JGDE01000005.1 | *Bacteroides fragilis* | 6231 | 7280 |
| NZ_JGDE01000133.1 | *Bacteroides fragilis* | 92211 | 93422 |
| NZ_JH370371.1 | *Alistipes indistinctus* | 1466197 | 1467243 |
| NZ_JH370372.1 | *Alistipes indistinctus* | 467211 | 466027 |
| NZ_JH724294.1 | *Bacteroides xylanisolvens* | 201312 | 200101 |
| NZ_JH724295.1 | *Bacteroides xylanisolvens* | 740942 | 741991 |
| NZ_KB946519.1 | *Enterococcus faecalis* | 432320 | 433351 |
| NZ_MTWC01000003.1 | *Clostridioides difficile* | 3052895 | 3051876 |
| NZ_MTWD01000001.1 | *Clostridioides difficile* | 3067290 | 3066271 |
| NZ_MTWE01000004.1 | *Clostridioides difficile* | 2778929 | 2777910 |
| NZ_MTWF01000021.1 | *Clostridioides difficile* | 126336 | 125317 |
| NZ_NSBZ01000002.1 | *Salmonella enterica* | 338306 | 337332 |
| NZ_PPUH01000003.1 | *Eggerthella lenta* | 25535 | 26617 |
| NZ_PUEL01000004.1 | *Ruminococcus gnavus* | 1103873 | 1102851 |
| NZ_PUEM01000006.1 | *Clostridium bolteae* | 5515992 | 5514973 |
| NZ_PUEO01000004.1 | *Bacteroides thetaiotaomicron* | 1074907 | 1075956 |
| NZ_PUEO01000014.1 | *Bacteroides thetaiotaomicron* | 699930 | 698719 |
| NZ_PUEP01000005.1 | *Bacteroides ovatus* | 3429039 | 3430250 |
| NZ_PUEP01000005.1 | *Bacteroides ovatus* | 4605120 | 4604071 |
| NZ_PUEQ01000003.1 | *Bacteroides caccae* | 2633686 | 2634897 |
| NZ_PUEQ01000003.1 | *Bacteroides caccae* | 3356989 | 3355940 |
| NZ_UFTH01000001.1 | *Bacteroides fragilis* | 1051923 | 1053134 |
| NZ_UFTH01000001.1 | *Bacteroides fragilis* | 2014558 | 2015607 |
| QEKH01000016.1 | *Victivallis vadensis* | 92415 | 91372 |
| BACDOR_03988 | | 41 | 204 |
| BT_1148 | | 7 | 170 |
| CVOZ01000016.1 | *Bacteroides thetaiotaomicron* | 104209 | 104940 |
| JGCP01000803.1 | *Bacteroides fragilis* | 3204 | 3473 |
| JGCP01002532.1 | *Bacteroides fragilis* | 1981 | 1532 |
| JGCP01002542.1 | *Bacteroides fragilis* | 44107 | 43376 |
| NC_000913.3 | *Escherichia coli* | 891196 | 891777 |
| NC_008618.1 | *Bifidobacterium adolescentis* | 1983240 | 1983764 |
| NC_009614.1 | *Bacteroides vulgatus* | 2241 | 1504 |
| NC_009614.1 | *Bacteroides vulgatus* | 2553354 | 2553839 |
| NC_009614.1 | *Bacteroides vulgatus* | 3238578 | 3238018 |
| NC_009615.1 | *Parabacteroides distasonis* | 2501051 | 2500311 |
| NC_009615.1 | *Parabacteroides distasonis* | 185234 | 184725 |
| NC_009615.1 | *Parabacteroides distasonis* | 2044489 | 2044971 |
| NZ_AAVM02000007.1 | *Bacteroides caccae* | 111194 | 111931 |
| NZ_AAVN02000007.1 | *Collinsella aerofaciens* | 68266 | 68859 |
| NZ_ABJL02000002.1 | *Bacteroides intestinalis* | 102975 | 102244 |
| NZ_ABJL02000008.1 | *Bacteroides intestinalis* | 2984894 | 2985385 |
| NZ_ACCL02000001.1 | *Marvinbryantia formatexigens* | 116314 | 117015 |
| NZ_ATFI01000004.1 | *Bacteroides cellulosilyticus* | 389871 | 390449 |
| NZ_ATFI01000004.1 | *Bacteroides cellulosilyticus* | 572171 | 572635 |
| NZ_ATFI01000006.1 | *Bacteroides cellulosilyticus* | 367144 | 367875 |
| NZ_CVOY01000001.1 | *Bacteroides thetaiotaomicron* | 257803 | 258534 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_DS264285.1 | Eubacterium ventriosum | 123016 | 122507 |
| NZ_DS264518.1 | Parabacteroides merdae | 27196 | 27927 |
| NZ_DS264580.1 | Bacteroides ovatus | 292879 | 293613 |
| NZ_DS362242.1 | Bacteroides uniformis | 188956 | 188219 |
| NZ_DS480690.1 | Clostridium bolteae | 89580 | 90023 |
| NZ_DS499655.1 | Erysipelatoclostridium ramosum | 354524 | 355015 |
| NZ_DS499676.1 | Bacteroides stercoris | 475435 | 474704 |
| NZ_DS499697.1 | Clostridium scindens | 281706 | 282383 |
| NZ_DS499697.1 | Clostridium scindens | 325343 | 325786 |
| NZ_DS562853.1 | Clostridium spiroforme | 140563 | 141048 |
| NZ_DS981517.1 | Clostridium sporogenes | 1671563 | 1672027 |
| NZ_DS981518.1 | Clostridium sporogenes | 524044 | 524577 |
| NZ_DS990198.1 | Ruminococcus lactaris | 16800 | 16285 |
| NZ_DS990242.1 | Bifidobacterium longum | 122060 | 122794 |
| NZ_DS995508.1 | Bacteroides eggerthii | 209488 | 210219 |
| NZ_DS995531.1 | Bacteroides dorei | 345468 | 346205 |
| NZ_DS995536.1 | Bacteroides dorei | 38613 | 38128 |
| NZ_DS995537.1 | Bacteroides dorei | 674814 | 674254 |
| NZ_DS996446.1 | Parabacteroides johnsonii | 59128 | 59640 |
| NZ_DS996456.1 | Parabacteroides johnsonii | 45966 | 45229 |
| NZ_DS996844.1 | Holdemanella biformis | 9201 | 9803 |
| NZ_DS996847.1 | Holdemanella biformis | 35961 | 36455 |
| NZ_EQ973489.1 | Bacteroides cellulosilyticus | 369930 | 370583 |
| NZ_EQ973491.1 | Bacteroides cellulosilyticus | 190366 | 189788 |
| NZ_EQ973651.1 | Bacteroides coprophilus | 153905 | 154642 |
| NZ_GG657595.1 | Clostridium asparagiforme | 13750 | 13313 |
| NZ_GG662012.1 | Coprococcus comes | 43441 | 42917 |
| NZ_GG688321.1 | Bacteroides finegoldii | 291692 | 290958 |
| NZ_GG688334.1 | Bacteroides finegoldii | 50704 | 51141 |
| NZ_GG692710.1 | Collinsella intestinalis | 1194654 | 1194136 |
| NZ_GG692723.1 | Roseburia intestinalis | 45135 | 44680 |
| NZ_GG693679.1 | Lactobacillus reuteri | 97 | 633 |
| NZ_GG698590.1 | Blautia hansenii | 424867 | 424271 |
| NZ_GG703854.1 | Prevotella copri | 357269 | 358000 |
| NZ_GG704774.1 | Subdoligranulum variabile | 1827 | 2453 |
| NZ_GG704863.1 | Enterobacter cancerogenus | 397912 | 398492 |
| NZ_GG729831.1 | Bifidobacterium breve | 6677 | 5940 |
| NZ_GG739633.1 | Edwardsiella tarda | 1759109 | 1758594 |
| NZ_JGDE01000133.1 | Bacteroides fragilis | 56983 | 56252 |
| NZ_JH370371.1 | Alistipes indistinctus | 1207458 | 1206736 |
| NZ_JH370372.1 | Alistipes indistinctus | 265973 | 265428 |
| NZ_JH724296.1 | Bacteroides xylanisolvens | 301016 | 300282 |
| NZ_KB946519.1 | Enterococcus faecalis | 784642 | 784046 |
| NZ_KE136402.1 | Enterococcus faecalis | 2316901 | 2317497 |
| NZ_MTWC01000003.1 | Clostridioides difficile | 183069 | 182566 |
| NZ_MTWD01000001.1 | Clostridioides difficile | 272104 | 271601 |
| NZ_PUEL01000004.1 | Ruminococcus gnavus | 423569 | 423006 |
| NZ_PUEM01000006.1 | Clostridium bolteae | 4759212 | 4759655 |
| NZ_PUEO01000011.1 | Bacteroides thetaiotaomicron | 338541 | 339272 |
| NZ_PUEP01000005.1 | Bacteroides ovatus | 562285 | 561656 |
| NZ_PUEP01000015.1 | Bacteroides ovatus | 146479 | 147213 |
| NZ_PUEQ01000003.1 | Bacteroides caccae | 349059 | 349796 |
| NZ_UFTH01000001.1 | Bacteroides fragilis | 1012777 | 1012046 |
| NZ_UFTH01000001.1 | Bacteroides fragilis | 627434 | 626985 |
| QEKH01000020.1 | Victivallis vadensis | 35006 | 35443 |
| BT_0569 | | 32 | 234 |
| BT_4075 | | 37 | 107 |
| BT_4096 | | 1 | 225 |
| CVOZ01000053.1 | Bacteroides thetaiotaomicron | 57242 | 56634 |
| JGCP01000996.1 | Bacteroides fragilis | 438 | 7 |
| JGCP01001374.1 | Bacteroides fragilis | 8889 | 9464 |
| JGCP01002361.1 | Bacteroides fragilis | 711 | 136 |
| JGCP01002366.1 | Bacteroides fragilis | 7394 | 6798 |
| JGCP01002441.1 | Bacteroides fragilis | 9814 | 10422 |
| JGCP01002459.1 | Bacteroides fragilis | 103650 | 103045 |
| JGCP01002552.1 | Bacteroides fragilis | 31137 | 31757 |
| NC_009614.1 | Bacteroides vulgatus | 5100333 | 5099671 |
| NC_009615.1 | Parabacteroides distasonis | 1135108 | 1135623 |
| NC_010655.1 | Akkermansia muciniphila | 28365 | 28967 |
| NZ_AAVM02000001.1 | Bacteroides caccae | 1240830 | 1240231 |
| NZ_AAVM02000003.1 | Bacteroides caccae | 380349 | 379744 |
| NZ_AAYG02000020.1 | Ruminococcus gnavus | 146583 | 146029 |
| NZ_ABJL02000006.1 | Bacteroides intestinalis | 363926 | 364525 |
| NZ_ATFI01000001.1 | Bacteroides cellulosilyticus | 142507 | 143106 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_CVOY01000005.1 | Bacteroides thetaiotaomicron | 209440 | 210048 |
| NZ_DS264582.1 | Bacteroides ovatus | 46715 | 46128 |
| NZ_DS362220.1 | Bacteroides uniformis | 323248 | 322721 |
| NZ_DS362220.1 | Bacteroides uniformis | 17094 | 16558 |
| NZ_DS362233.1 | Bacteroides uniformis | 68137 | 68724 |
| NZ_DS362246.1 | Bacteroides uniformis | 117769 | 117260 |
| NZ_DS480679.1 | Clostridium bolteae | 119727 | 120254 |
| NZ_DS499674.1 | Bacteroides stercoris | 577837 | 577238 |
| NZ_DS562848.1 | Clostridium spiroforme | 372214 | 372744 |
| NZ_DS995510.1 | Bacteroides eggerthii | 656723 | 657343 |
| NZ_DS995511.1 | Bacteroides eggerthii | 728361 | 727798 |
| NZ_DS995531.1 | Bacteroides dorei | 447813 | 448475 |
| NZ_DS996921.1 | Bacteroides pectinophilus | 466835 | 467326 |
| NZ_EQ973490.1 | Bacteroides cellulosilyticus | 257404 | 258003 |
| NZ_EQ973490.1 | Bacteroides cellulosilyticus | 916952 | 917088 |
| NZ_GG657592.1 | Clostridium asparagiforme | 3235183 | 3234566 |
| NZ_GG688322.1 | Bacteroides finegoldii | 129579 | 130202 |
| NZ_GG692731.1 | Roseburia intestinalis | 64242 | 63706 |
| NZ_GG704769.1 | Subdoligranulum variabile | 1963367 | 1962822 |
| NZ_JGDE01000016.1 | Bacteroides fragilis | 30454 | 29879 |
| NZ_JGDE01000017.1 | Bacteroides fragilis | 7455 | 6859 |
| NZ_JGDE01000072.1 | Bacteroides fragilis | 9293 | 9901 |
| NZ_JGDE01000091.1 | Bacteroides fragilis | 22097 | 21492 |
| NZ_JGDE01000136.1 | Bacteroides fragilis | 27267 | 27887 |
| NZ_JH370372.1 | Alistipes indistinctus | 98423 | 97824 |
| NZ_JH724294.1 | Bacteroides xylanisolvens | 2429518 | 2428898 |
| NZ_PUEL01000004.1 | Ruminococcus gnavus | 1632318 | 1631764 |
| NZ_PUEM01000006.1 | Clostridium bolteae | 5989960 | 5990487 |
| NZ_PUEO01000014.1 | Bacteroides thetaiotaomicron | 2506964 | 2507572 |
| NZ_PUEP01000005.1 | Bacteroides ovatus | 917658 | 918245 |
| NZ_PUEQ01000003.1 | Bacteroides caccae | 1529639 | 1529040 |
| NZ_PUEQ01000003.1 | Bacteroides caccae | 2324622 | 2325227 |
| NZ_UFTH01000001.1 | Bacteroides fragilis | 4050588 | 4051196 |
| NZ_UFTH01000001.1 | Bacteroides fragilis | 2389564 | 2388968 |
| NZ_UFTH01000001.1 | Bacteroides fragilis | 1188676 | 1189296 |
| NZ_UFTH01000001.1 | Bacteroides fragilis | 4569605 | 4569000 |
| NZ_UFTH01000001.1 | Bacteroides fragilis | 2353159 | 2352584 |
| NZ_UFTH01000005.1 | Bacteroides fragilis | 8645 | 9220 |
| QEKH01000033.1 | Victivallis vadensis | 30085 | 29582 |
| NZ_CVOY01000074.1 | Bacteroides thetaiotaomicron | 35629 | 37335 |
| NZ_DS544177.1 | Anaerotruncus colihominis | 189303 | 188698 |
| NZ_DS995508.1 | Bacteroides eggerthii | 515682 | 513877 |
| NZ_DS995532.1 | Bacteroides dorei | 23809 | 25614 |
| NZ_EQ973637.1 | Bacteroides coprophilus | 53028 | 51301 |
| NZ_EQ973637.1 | Bacteroides coprophilus | 245618 | 243906 |
| NZ_EQ973651.1 | Bacteroides coprophilus | 5698 | 4001 |
| NZ_UFTH01000001.1 | Bacteroides fragilis | 4306248 | 4304464 |
| CVOZ01000037.1 | Bacteroides thetaiotaomicron | 13492 | 12218 |
| JGCP01002370.1 | Bacteroides fragilis | 62642 | 63922 |
| NC_009614.1 | Bacteroides vulgatus | 1946317 | 1945031 |
| NC_009615.1 | Parabacteroides distasonis | 3695035 | 3696270 |
| NZ_ABJL02000007.1 | Bacteroides intestinalis | 1302828 | 1301614 |
| NZ_ATFI01000007.1 | Bacteroides cellulosilyticus | 489104 | 490372 |
| NZ_CVOY01000020.1 | Bacteroides thetaiotaomicron | 109540 | 110814 |
| NZ_DS264542.1 | Parabacteroides merdae | 110435 | 109170 |
| NZ_DS362243.1 | Bacteroides uniformis | 74012 | 72777 |
| NZ_DS499676.1 | Bacteroides stercoris | 78183 | 79397 |
| NZ_DS995534.1 | Bacteroides dorei | 879429 | 878143 |
| NZ_DS996444.1 | Parabacteroides johnsonii | 721304 | 720039 |
| NZ_EQ973492.1 | Bacteroides cellulosilyticus | 1012038 | 1013306 |
| NZ_JGDE01000020.1 | Bacteroides fragilis | 8680 | 9897 |
| NZ_PUEO01000004.1 | Bacteroides thetaiotaomicron | 20242 | 18968 |
| NZ_UFTH01000001.1 | Bacteroides fragilis | 2558717 | 2559997 |
| BT_2068 | | 1 | 253 |
| CVOZ01000016.1 | Bacteroides thetaiotaomicron | 213809 | 214567 |
| JGCP01001391.1 | Bacteroides fragilis | 1827 | 1213 |
| JGCP01002541.1 | Bacteroides fragilis | 59029 | 58271 |
| NC_009614.1 | Bacteroides vulgatus | 2545071 | 2545832 |
| NZ_AAVM02000007.1 | Bacteroides caccae | 240333 | 241091 |
| NZ_ABJL02000002.1 | Bacteroides intestinalis | 14878 | 14120 |
| NZ_ATFI01000018.1 | Bacteroides cellulosilyticus | 73581 | 72838 |
| NZ_CVOY01000004.1 | Bacteroides thetaiotaomicron | 107627 | 108385 |
| NZ_DS264546.1 | Parabacteroides merdae | 161605 | 162363 |
| NZ_DS264580.1 | Bacteroides ovatus | 422161 | 422919 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_DS362242.1 | *Bacteroides uniformis* | 128891 | 128124 |
| NZ_DS499676.1 | *Bacteroides stercoris* | 354507 | 353740 |
| NZ_DS995508.1 | *Bacteroides eggerthii* | 374349 | 375116 |
| NZ_DS995536.1 | *Bacteroides dorei* | 46897 | 46136 |
| NZ_DS996453.1 | *Parabacteroides johnsonii* | 310455 | 311213 |
| NZ_EQ973489.1 | *Bacteroides cellulosilyticus* | 471401 | 472159 |
| NZ_EQ973643.1 | *Bacteroides coprophilus* | 27626 | 28387 |
| NZ_GG688318.1 | *Bacteroides finegoldii* | 85948 | 85178 |
| NZ_GG688321.1 | *Bacteroides finegoldii* | 185788 | 185030 |
| NZ_JGDE01000131.1 | *Bacteroides fragilis* | 10637 | 9879 |
| NZ_JH370372.1 | *Alistipes indistinctus* | 247945 | 248700 |
| NZ_JH724296.1 | *Bacteroides xylanisolvens* | 113928 | 113170 |
| NZ_PUEO01000011.1 | *Bacteroides thetaiotaomicron* | 447878 | 448636 |
| NZ_PUEP01000015.1 | *Bacteroides ovatus* | 275761 | 276519 |
| NZ_PUEQ01000003.1 | *Bacteroides caccae* | 478198 | 478956 |
| NZ_UFTH01000001.1 | *Bacteroides fragilis* | 906258 | 905500 |
| NZ_DS995536.1 | *Bacteroides dorei* | 48870 | 47308 |
| NZ_PUEO01000014.1 | *Bacteroides thetaiotaomicron* | 751938 | 753500 |
| BT_2961 | | 1 | 285 |
| BT_4075 | | 177 | 235 |
| BT_4096 | | 158 | 231 |
| COLAER_00815 | | 96 | 240 |
| CVOZ01000004.1 | *Bacteroides thetaiotaomicron* | 1448 | 2302 |
| CVOZ01000011.1 | *Bacteroides thetaiotaomicron* | 76261 | 77025 |
| JGCP01002268.1 | *Bacteroides fragilis* | 1309 | 668 |
| NC_009614.1 | *Bacteroides vulgatus* | 2618474 | 2619322 |
| NZ_AAVM02000002.1 | *Bacteroides caccae* | 22009 | 21158 |
| NZ_CVOY01000037.1 | *Bacteroides thetaiotaomicron* | 89304 | 90158 |
| NZ_DS264554.1 | *Bacteroides ovatus* | 556078 | 555293 |
| NZ_DS995537.1 | *Bacteroides dorei* | 24054 | 24902 |
| NZ_DS996456.1 | *Parabacteroides johnsonii* | 449203 | 448439 |
| NZ_JH724295.1 | *Bacteroides xylanisolvens* | 331780 | 330995 |
| NZ_JH724300.1 | *Bacteroides xylanisolvens* | 14631 | 13909 |
| NZ_PUEO01000004.1 | *Bacteroides thetaiotaomicron* | 699564 | 698710 |
| NZ_PUEP01000005.1 | *Bacteroides ovatus* | 5040250 | 5041035 |
| NZ_PUEQ01000003.1 | *Bacteroides caccae* | 3599902 | 3600753 |
| CVOZ01000032.1 | *Bacteroides thetaiotaomicron* | 278437 | 277562 |
| CVOZ01000032.1 | *Bacteroides thetaiotaomicron* | 327847 | 326954 |
| CVOZ01000032.1 | *Bacteroides thetaiotaomicron* | 335851 | 336507 |
| CVOZ01000032.1 | *Bacteroides thetaiotaomicron* | 289144 | 289842 |
| CVOZ01000032.1 | *Bacteroides thetaiotaomicron* | 289870 | 290580 |
| CVOZ01000033.1 | *Bacteroides thetaiotaomicron* | 38815 | 37955 |
| JGCP01000713.1 | *Bacteroides fragilis* | 233 | 931 |
| JGCP01000713.1 | *Bacteroides fragilis* | 959 | 1468 |
| JGCP01001256.1 | *Bacteroides fragilis* | 1150 | 194 |
| JGCP01001408.1 | *Bacteroides fragilis* | 564 | 1220 |
| NC_009614.1 | *Bacteroides vulgatus* | 2779799 | 2781439 |
| NC_009614.1 | *Bacteroides vulgatus* | 2620046 | 2620657 |
| NC_009614.1 | *Bacteroides vulgatus* | 2619532 | 2620038 |
| NC_009614.1 | *Bacteroides vulgatus* | 2352196 | 2353167 |
| NC_009614.1 | *Bacteroides vulgatus* | 2620668 | 2621141 |
| NC_009614.1 | *Bacteroides vulgatus* | 288953 | 289606 |
| NC_009614.1 | *Bacteroides vulgatus* | 244590 | 243868 |
| NC_009614.1 | *Bacteroides vulgatus* | 245316 | 244618 |
| NC_009614.1 | *Bacteroides vulgatus* | 2620777 | 2620842 |
| NC_009614.1 | *Bacteroides vulgatus* | 2620841 | 2620945 |
| NZ_AAVM02000003.1 | *Bacteroides caccae* | 187381 | 188355 |
| NZ_AAYG02000020.1 | *Ruminococcus gnavus* | 156048 | 155356 |
| NZ_ABJL02000002.1 | *Bacteroides intestinalis* | 153696 | 152815 |
| NZ_ABJL02000002.1 | *Bacteroides intestinalis* | 242190 | 241192 |
| NZ_ABJL02000008.1 | *Bacteroides intestinalis* | 2826397 | 2825381 |
| NZ_ABJL02000008.1 | *Bacteroides intestinalis* | 2603612 | 2602923 |
| NZ_ABJL02000008.1 | *Bacteroides intestinalis* | 3206175 | 3206885 |
| NZ_ABJL02000008.1 | *Bacteroides intestinalis* | 3205449 | 3206435 |
| NZ_ATFI01000004.1 | *Bacteroides cellulosilyticus* | 193354 | 192338 |
| NZ_ATFI01000004.1 | *Bacteroides cellulosilyticus* | 698860 | 699570 |
| NZ_ATFI01000004.1 | *Bacteroides cellulosilyticus* | 698128 | 699120 |
| NZ_ATFI01000006.1 | *Bacteroides cellulosilyticus* | 337473 | 338303 |
| NZ_ATFI01000009.1 | *Bacteroides cellulosilyticus* | 425892 | 425203 |
| NZ_CVOY01000002.1 | *Bacteroides thetaiotaomicron* | 10928 | 11803 |
| NZ_CVOY01000004.1 | *Bacteroides thetaiotaomicron* | 33471 | 34445 |
| NZ_CVOY01000030.1 | *Bacteroides thetaiotaomicron* | 60870 | 61763 |
| NZ_CVOY01000030.1 | *Bacteroides thetaiotaomicron* | 51365 | 50709 |
| NZ_CVOY01000108.1 | *Bacteroides thetaiotaomicron* | 179 | 877 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_CVOY01000108.1 | Bacteroides thetaiotaomicron | 905 | 1615 |
| NZ_DS264554.1 | Bacteroides ovatus | 198660 | 199562 |
| NZ_DS264554.1 | Bacteroides ovatus | 197946 | 198665 |
| NZ_DS264579.1 | Bacteroides ovatus | 101730 | 101050 |
| NZ_DS264579.1 | Bacteroides ovatus | 102462 | 101758 |
| NZ_DS264584.1 | Bacteroides ovatus | 301586 | 302560 |
| NZ_DS264584.1 | Bacteroides ovatus | 428271 | 429146 |
| NZ_DS264584.1 | Bacteroides ovatus | 377614 | 376958 |
| NZ_DS264584.1 | Bacteroides ovatus | 434485 | 435183 |
| NZ_DS264584.1 | Bacteroides ovatus | 417597 | 416878 |
| NZ_DS264584.1 | Bacteroides ovatus | 418350 | 417574 |
| NZ_DS362249.1 | Bacteroides uniformis | 289634 | 288054 |
| NZ_DS499676.1 | Bacteroides stercoris | 561250 | 560255 |
| NZ_DS981517.1 | Clostridium sporogenes | 457008 | 457370 |
| NZ_DS990171.1 | Ruminococcus lactaris | 5187 | 5534 |
| NZ_DS995509.1 | Bacteroides eggerthii | 327513 | 328508 |
| NZ_DS995531.1 | Bacteroides dorei | 93535 | 94410 |
| NZ_DS995531.1 | Bacteroides dorei | 50130 | 49477 |
| NZ_DS995531.1 | Bacteroides dorei | 106361 | 107083 |
| NZ_DS995531.1 | Bacteroides dorei | 105635 | 106333 |
| NZ_DS995536.1 | Bacteroides dorei | 242505 | 241396 |
| NZ_DS995537.1 | Bacteroides dorei | 25114 | 27072 |
| NZ_DS995537.1 | Bacteroides dorei | 1373127 | 1374776 |
| NZ_DS996921.1 | Bacteroides pectinophilus | 1405526 | 1406158 |
| NZ_EQ973486.1 | Bacteroides cellulosilyticus | 92459 | 91749 |
| NZ_EQ973486.1 | Bacteroides cellulosilyticus | 93191 | 92199 |
| NZ_EQ973489.1 | Bacteroides cellulosilyticus | 322372 | 323022 |
| NZ_EQ973491.1 | Bacteroides cellulosilyticus | 393142 | 394158 |
| NZ_EQ973491.1 | Bacteroides cellulosilyticus | 671842 | 672531 |
| NZ_EQ973492.1 | Bacteroides cellulosilyticus | 492581 | 491853 |
| NZ_GG688320.1 | Bacteroides finegoldii | 264894 | 263914 |
| NZ_GG688320.1 | Bacteroides finegoldii | 202708 | 203607 |
| NZ_GG688320.1 | Bacteroides finegoldii | 231551 | 232207 |
| NZ_GG688320.1 | Bacteroides finegoldii | 195186 | 194512 |
| NZ_GG688320.1 | Bacteroides finegoldii | 209971 | 210669 |
| NZ_GG688320.1 | Bacteroides finegoldii | 210700 | 211410 |
| NZ_GG692716.1 | Roseburia intestinalis | 57615 | 58253 |
| NZ_GG703858.1 | Prevotella copri | 109675 | 108758 |
| NZ_JH370372.1 | Alistipes indistinctus | 102822 | 102526 |
| NZ_JH724294.1 | Bacteroides xylanisolvens | 390497 | 391471 |
| NZ_PUEL01000004.1 | Ruminococcus gnavus | 1641783 | 1641091 |
| NZ_PUEL01000004.1 | Ruminococcus gnavus | 2394471 | 2394827 |
| NZ_PUEO01000014.1 | Bacteroides thetaiotaomicron | 899572 | 900546 |
| NZ_PUEO01000014.1 | Bacteroides thetaiotaomicron | 1031435 | 1032310 |
| NZ_PUEO01000014.1 | Bacteroides thetaiotaomicron | 982003 | 982896 |
| NZ_PUEO01000014.1 | Bacteroides thetaiotaomicron | 973993 | 973337 |
| NZ_PUEO01000014.1 | Bacteroides thetaiotaomicron | 1020728 | 1020030 |
| NZ_PUEO01000014.1 | Bacteroides thetaiotaomicron | 1020002 | 1019292 |
| NZ_PUEP01000005.1 | Bacteroides ovatus | 3144163 | 3143189 |
| NZ_PUEP01000005.1 | Bacteroides ovatus | 5398858 | 5397956 |
| NZ_PUEP01000005.1 | Bacteroides ovatus | 3017478 | 3016603 |
| NZ_PUEP01000005.1 | Bacteroides ovatus | 5399572 | 5398853 |
| NZ_PUEP01000005.1 | Bacteroides ovatus | 3068135 | 3068791 |
| NZ_PUEP01000005.1 | Bacteroides ovatus | 3011264 | 3010566 |
| NZ_PUEP01000005.1 | Bacteroides ovatus | 3028152 | 3028871 |
| NZ_PUEP01000005.1 | Bacteroides ovatus | 3027399 | 3028175 |
| NZ_PUEP01000005.1 | Bacteroides ovatus | 4920170 | 4920850 |
| NZ_PUEP01000005.1 | Bacteroides ovatus | 4919438 | 4920142 |
| NZ_PUEQ01000003.1 | Bacteroides caccae | 2517594 | 2516620 |
| QEKH01000014.1 | Victivallis vadensis | 69266 | 69907 |
| BT_1192 | | 363 | 462 |
| BT_3124 | | 260 | 347 |
| COLAER_00815 | | 69 | 229 |
| CVOZ01000032.1 | Bacteroides thetaiotaomicron | 320584 | 319970 |
| CVOZ01000032.1 | Bacteroides thetaiotaomicron | 279286 | 278453 |
| NC_009614.1 | Bacteroides vulgatus | 3010156 | 3011628 |
| NZ_ABJL02000002.1 | Bacteroides intestinalis | 241062 | 240220 |
| NZ_ABJL02000008.1 | Bacteroides intestinalis | 2609905 | 2610504 |
| NZ_CVOY01000002.1 | Bacteroides thetaiotaomicron | 10079 | 10912 |
| NZ_CVOY01000030.1 | Bacteroides thetaiotaomicron | 76891 | 77505 |
| NZ_DS264584.1 | Bacteroides ovatus | 442833 | 441991 |
| NZ_DS995537.1 | Bacteroides dorei | 355341 | 356813 |
| NZ_DS996921.1 | Bacteroides pectinophilus | 215285 | 215857 |
| NZ_PUEO01000014.1 | Bacteroides thetaiotaomicron | 989267 | 989881 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_PUEO01000014.1 | Bacteroides thetaiotaomicron | 1030586 | 1031419 |
| NZ_PUEP01000005.1 | Bacteroides ovatus | 3002916 | 3003758 |
| CVOZ01000025.1 | Bacteroides thetaiotaomicron | 228497 | 228021 |
| JGCP01002418.1 | Bacteroides fragilis | 53739 | 53263 |
| NC_009614.1 | Bacteroides vulgatus | 3013253 | 3012750 |
| NC_009615.1 | Parabacteroides distasonis | 2483154 | 2482669 |
| NC_012781.1 | Eubacterium rectale | 275468 | 275845 |
| NZ_AAVM02000006.1 | Bacteroides caccae | 294260 | 293784 |
| NZ_AAXA02000015.1 | Dorea formicigenerans | 81674 | 81237 |
| NZ_AAYG02000020.1 | Ruminococcus gnavus | 14089 | 13706 |
| NZ_ABJL02000008.1 | Bacteroides intestinalis | 1575489 | 1575968 |
| NZ_ABXA01000014.1 | Anaerococcus hydrogenalis | 10995 | 11324 |
| NZ_ACCL02000004.1 | Marvinbryantia formatexigens | 228462 | 228866 |
| NZ_ATFI01000017.1 | Bacteroides cellulosilyticus | 48893 | 49372 |
| NZ_CVOY01000013.1 | Bacteroides thetaiotaomicron | 68589 | 68113 |
| NZ_DS264284.1 | Eubacterium ventriosum | 34205 | 33930 |
| NZ_DS264346.1 | Ruminococcus torques | 54583 | 54975 |
| NZ_DS264518.1 | Parabacteroides merdae | 43023 | 43499 |
| NZ_DS264583.1 | Bacteroides ovatus | 165036 | 165512 |
| NZ_DS362249.1 | Bacteroides uniformis | 38171 | 38653 |
| NZ_DS480678.1 | Clostridium bolteae | 117255 | 116866 |
| NZ_DS499655.1 | Erysipelatoclostridium ramosum | 390371 | 390754 |
| NZ_DS499671.1 | Bacteroides stercoris | 73424 | 73900 |
| NZ_DS499697.1 | Clostridium scindens | 310825 | 310430 |
| NZ_DS544181.1 | Anaerotruncus colihominis | 168009 | 167620 |
| NZ_DS562853.1 | Clostridium spiroforme | 159590 | 159871 |
| NZ_DS981517.1 | Clostridium sporogenes | 734347 | 734709 |
| NZ_DS990204.1 | Ruminococcus lactaris | 1040 | 633 |
| NZ_DS995509.1 | Bacteroides eggerthii | 1263753 | 1263277 |
| NZ_DS995537.1 | Bacteroides dorei | 357809 | 357306 |
| NZ_DS996456.1 | Parabacteroides johnsonii | 29766 | 29311 |
| NZ_DS996922.1 | Bacteroides pectinophilus | 5548 | 5931 |
| NZ_EQ973488.1 | Bacteroides cellulosilyticus | 349840 | 350319 |
| NZ_EQ973651.1 | Bacteroides coprophilus | 150422 | 149964 |
| NZ_GG657592.1 | Clostridium asparagiforme | 1177311 | 1177730 |
| NZ_GG667608.1 | Hungatella hathewayi | 147420 | 147797 |
| NZ_GG688318.1 | Bacteroides finegoldii | 355312 | 354836 |
| NZ_GG692711.1 | Collinsella intestinalis | 96648 | 97034 |
| NZ_GG692730.1 | Roseburia intestinalis | 30330 | 29962 |
| NZ_GG698588.1 | Blautia hansenii | 167573 | 167190 |
| NZ_GG703872.1 | Prevotella copri | 670 | 194 |
| NZ_GG704769.1 | Subdoligranulum variabile | 1484289 | 1483900 |
| NZ_JGDE01000051.1 | Bacteroides fragilis | 16766 | 16290 |
| NZ_JH370372.1 | Alistipes indistinctus | 1077514 | 1077068 |
| NZ_JH724297.1 | Bacteroides xylanisolvens | 316915 | 317391 |
| NZ_KE136402.1 | Enterococcus faecalis | 75167 | 74802 |
| NZ_MTWC01000003.1 | Clostridioides difficile | 2570171 | 2569785 |
| NZ_MTWD01000001.1 | Clostridioides difficile | 2608785 | 2608399 |
| NZ_MTWE01000004.1 | Clostridioides difficile | 2328222 | 2327836 |
| NZ_PUEL01000004.1 | Ruminococcus gnavus | 1499825 | 1499442 |
| NZ_PUEM01000006.1 | Clostridium bolteae | 4150728 | 4151117 |
| NZ_PUEO01000014.1 | Bacteroides thetaiotaomicron | 3701254 | 3701730 |
| NZ_PUEP01000005.1 | Bacteroides ovatus | 339730 | 339254 |
| NZ_PUEQ01000002.1 | Bacteroides caccae | 341319 | 340843 |
| NZ_UFTH01000001.1 | Bacteroides fragilis | 3641424 | 3640948 |
| CVOZ01000042.1 | Bacteroides thetaiotaomicron | 34688 | 34368 |
| JGCP01002359.1 | Bacteroides fragilis | 41068 | 41324 |
| NC_000913.3 | Escherichia coli | 904593 | 904904 |
| NC_009614.1 | Bacteroides vulgatus | 3013445 | 3013765 |
| NC_009615.1 | Parabacteroides distasonis | 3249031 | 3249348 |
| NZ_AAVM02000009.1 | Bacteroides caccae | 17283 | 17603 |
| NZ_ABJL02000007.1 | Bacteroides intestinalis | 704388 | 704705 |
| NZ_ATFI01000001.1 | Bacteroides cellulosilyticus | 421004 | 420687 |
| NZ_CVOY01000010.1 | Bacteroides thetaiotaomicron | 7919 | 7599 |
| NZ_DS264359.1 | Ruminococcus torques | 17253 | 17570 |
| NZ_DS264364.1 | Ruminococcus torques | 42135 | 42452 |
| NZ_DS264544.1 | Parabacteroides merdae | 742 | 425 |
| NZ_DS362223.1 | Bacteroides uniformis | 11655 | 11972 |
| NZ_DS362246.1 | Bacteroides uniformis | 3066 | 3389 |
| NZ_DS499674.1 | Bacteroides stercoris | 462363 | 462680 |
| NZ_DS544185.1 | Anaerotruncus colihominis | 14445 | 14128 |
| NZ_DS562844.1 | Clostridium spiroforme | 291249 | 291566 |
| NZ_DS981517.1 | Clostridium sporogenes | 935496 | 935179 |
| NZ_DS990238.1 | Bifidobacterium longum | 668976 | 668662 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS995511.1 | *Bacteroides eggerthii* | 638934 | 639251 |
| NZ_DS995537.1 | *Bacteroides dorei* | 358000 | 358320 |
| NZ_DS996456.1 | *Parabacteroides johnsonii* | 1015093 | 1015410 |
| NZ_EQ973490.1 | *Bacteroides cellulosilyticus* | 533321 | 533004 |
| NZ_EQ973647.1 | *Bacteroides coprophilus* | 14447 | 14764 |
| NZ_GG692710.1 | *Collinsella intestinalis* | 1023607 | 1023903 |
| NZ_GG703853.1 | *Prevotella copri* | 386355 | 386041 |
| NZ_GG704863.1 | *Enterobacter cancerogenus* | 413348 | 413659 |
| NZ_GG729830.1 | *Bifidobacterium breve* | 191349 | 191663 |
| NZ_JGDE01000013.1 | *Bacteroides fragilis* | 22693 | 23010 |
| NZ_JH724295.1 | *Bacteroides xylanisolvens* | 1124087 | 1124407 |
| NZ_MTWC01000003.1 | *Clostridioides difficile* | 1788196 | 1788510 |
| NZ_MTWD01000001.1 | *Clostridioides difficile* | 1830939 | 1831253 |
| NZ_MTWE01000004.1 | *Clostridioides difficile* | 1523761 | 1524075 |
| NZ_PUEO01000004.1 | *Bacteroides thetaiotaomicron* | 1360437 | 1360757 |
| NZ_PUEQ01000003.1 | *Bacteroides caccae* | 3090859 | 3090539 |
| NZ_UFTH01000001.1 | *Bacteroides fragilis* | 2193266 | 2193583 |
| BACDOR_03648 | | 2 | 191 |
| CVOZ01000037.1 | *Bacteroides thetaiotaomicron* | 90333 | 89671 |
| CVOZ01000037.1 | *Bacteroides thetaiotaomicron* | 90656 | 90387 |
| JGCP01002370.1 | *Bacteroides fragilis* | 19946 | 20590 |
| JGCP01002370.1 | *Bacteroides fragilis* | 19647 | 19904 |
| NC_009614.1 | *Bacteroides vulgatus* | 3014449 | 3013841 |
| NC_009614.1 | *Bacteroides vulgatus* | 3015154 | 3014498 |
| NZ_AAVM02000001.1 | *Bacteroides caccae* | 401183 | 401740 |
| NZ_AAVM02000001.1 | *Bacteroides caccae* | 400813 | 401082 |
| NZ_ABJL02000008.1 | *Bacteroides intestinalis* | 189847 | 189212 |
| NZ_ATFI01000007.1 | *Bacteroides cellulosilyticus* | 182016 | 182639 |
| NZ_CVOY01000020.1 | *Bacteroides thetaiotaomicron* | 75232 | 75894 |
| NZ_CVOY01000020.1 | *Bacteroides thetaiotaomicron* | 74909 | 75178 |
| NZ_DS264554.1 | *Bacteroides ovatus* | 96010 | 95354 |
| NZ_DS264554.1 | *Bacteroides ovatus* | 96327 | 96058 |
| NZ_DS362237.1 | *Bacteroides uniformis* | 68919 | 68383 |
| NZ_DS995537.1 | *Bacteroides dorei* | 359004 | 358396 |
| NZ_DS995537.1 | *Bacteroides dorei* | 359709 | 359053 |
| NZ_EQ973492.1 | *Bacteroides cellulosilyticus* | 702548 | 703171 |
| NZ_GG703853.1 | *Prevotella copri* | 10442 | 9792 |
| NZ_JGDE01000019.1 | *Bacteroides fragilis* | 85207 | 85851 |
| NZ_JGDE01000019.1 | *Bacteroides fragilis* | 84908 | 85165 |
| NZ_JH724299.1 | *Bacteroides xylanisolvens* | 71964 | 72233 |
| NZ_PUEO01000004.1 | *Bacteroides thetaiotaomicron* | 97086 | 96424 |
| NZ_PUEO01000004.1 | *Bacteroides thetaiotaomicron* | 97409 | 97140 |
| NZ_PUEP01000005.1 | *Bacteroides ovatus* | 5502584 | 5503240 |
| NZ_PUEP01000005.1 | *Bacteroides ovatus* | 5502267 | 5502536 |
| NZ_PUEQ01000003.1 | *Bacteroides caccae* | 74218 | 74775 |
| NZ_PUEQ01000003.1 | *Bacteroides caccae* | 73848 | 74117 |
| NZ_UFTH01000001.1 | *Bacteroides fragilis* | 2516016 | 2516660 |
| NZ_UFTH01000001.1 | *Bacteroides fragilis* | 2515717 | 2515974 |
| BACDOR_03647 | | 31 | 202 |
| CVOZ01000037.1 | *Bacteroides thetaiotaomicron* | 90246 | 89671 |
| JGCP01002370.1 | *Bacteroides fragilis* | 20039 | 20590 |
| NC_009614.1 | *Bacteroides vulgatus* | 3015070 | 3014486 |
| NC_009614.1 | *Bacteroides vulgatus* | 3014359 | 3013844 |
| NZ_AAVM02000001.1 | *Bacteroides caccae* | 401216 | 401779 |
| NZ_AAVM02000001.1 | *Bacteroides caccae* | 400750 | 401082 |
| NZ_ABJL02000008.1 | *Bacteroides intestinalis* | 189775 | 189191 |
| NZ_ATFI01000007.1 | *Bacteroides cellulosilyticus* | 182088 | 182639 |
| NZ_CVOY01000020.1 | *Bacteroides thetaiotaomicron* | 75319 | 75894 |
| NZ_DS264554.1 | *Bacteroides ovatus* | 95923 | 95354 |
| NZ_DS264554.1 | *Bacteroides ovatus* | 96381 | 96097 |
| NZ_DS362237.1 | *Bacteroides uniformis* | 68919 | 68383 |
| NZ_DS995537.1 | *Bacteroides dorei* | 359625 | 359041 |
| NZ_DS995537.1 | *Bacteroides dorei* | 358914 | 358399 |
| NZ_EQ973492.1 | *Bacteroides cellulosilyticus* | 702620 | 703171 |
| NZ_GG688330.1 | *Bacteroides finegoldii* | 122724 | 123047 |
| NZ_GG703853.1 | *Prevotella copri* | 10352 | 9831 |
| NZ_JGDE01000019.1 | *Bacteroides fragilis* | 85300 | 85851 |
| NZ_JH724299.1 | *Bacteroides xylanisolvens* | 71928 | 72194 |
| NZ_PUEO01000004.1 | *Bacteroides thetaiotaomicron* | 96999 | 96424 |
| NZ_PUEP01000005.1 | *Bacteroides ovatus* | 5502671 | 5503240 |
| NZ_PUEP01000005.1 | *Bacteroides ovatus* | 5502213 | 5502497 |
| NZ_PUEQ01000003.1 | *Bacteroides caccae* | 74251 | 74814 |
| NZ_PUEQ01000003.1 | *Bacteroides caccae* | 73785 | 74117 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_UFTH01000001.1 | Bacteroides fragilis | 2516109 | 2516660 |
| BT_2367 | | 1 | 382 |
| CVOZ01000011.1 | Bacteroides thetaiotaomicron | 219307 | 218162 |
| CVOZ01000025.1 | Bacteroides thetaiotaomicron | 65956 | 64922 |
| JGCP01000352.1 | Bacteroides fragilis | 1001 | 3 |
| JGCP01002360.1 | Bacteroides fragilis | 22362 | 21214 |
| NC_009614.1 | Bacteroides vulgatus | 3184401 | 3185549 |
| NC_009615.1 | Parabacteroides distasonis | 4010282 | 4011415 |
| NC_010655.1 | Akkermansia muciniphila | 2181545 | 2180451 |
| NC_010655.1 | Akkermansia muciniphila | 910779 | 911906 |
| NZ_AAVM02000006.1 | Bacteroides caccae | 286961 | 285936 |
| NZ_AAVM02000010.1 | Bacteroides caccae | 85750 | 86895 |
| NZ_ABJL02000007.1 | Bacteroides intestinalis | 1352596 | 1353708 |
| NZ_ABJL02000008.1 | Bacteroides intestinalis | 11440 | 12579 |
| NZ_ACEP01000056.1 | Eubacterium hallii | 19442 | 19756 |
| NZ_ATFI01000007.1 | Bacteroides cellulosilyticus | 320605 | 319457 |
| NZ_ATFI01000007.1 | Bacteroides cellulosilyticus | 180818 | 179655 |
| NZ_ATFI01000007.1 | Bacteroides cellulosilyticus | 433197 | 432085 |
| NZ_ATFI01000008.1 | Bacteroides cellulosilyticus | 454543 | 453536 |
| NZ_CVOY01000001.1 | Bacteroides thetaiotaomicron | 78559 | 77414 |
| NZ_CVOY01000013.1 | Bacteroides thetaiotaomicron | 61418 | 60384 |
| NZ_DS264546.1 | Parabacteroides merdae | 79517 | 80632 |
| NZ_DS264553.1 | Bacteroides ovatus | 176886 | 178034 |
| NZ_DS264583.1 | Bacteroides ovatus | 172699 | 173733 |
| NZ_DS362220.1 | Bacteroides uniformis | 32930 | 34078 |
| NZ_DS362243.1 | Bacteroides uniformis | 130985 | 132106 |
| NZ_DS499676.1 | Bacteroides stercoris | 625044 | 623935 |
| NZ_DS499676.1 | Bacteroides stercoris | 38390 | 37269 |
| NZ_DS995510.1 | Bacteroides eggerthii | 1115618 | 1114497 |
| NZ_DS995537.1 | Bacteroides dorei | 622799 | 623947 |
| NZ_DS996453.1 | Parabacteroides johnsonii | 228018 | 229163 |
| NZ_DS996453.1 | Parabacteroides johnsonii | 441885 | 442970 |
| NZ_EQ973492.1 | Bacteroides cellulosilyticus | 841963 | 840815 |
| NZ_EQ973492.1 | Bacteroides cellulosilyticus | 701350 | 700187 |
| NZ_EQ973495.1 | Bacteroides cellulosilyticus | 221652 | 222659 |
| NZ_EQ973543.1 | Bacteroides cellulosilyticus | 701 | 3 |
| NZ_EQ973643.1 | Bacteroides coprophilus | 523657 | 524796 |
| NZ_GG688326.1 | Bacteroides finegoldii | 160819 | 161967 |
| NZ_JH370372.1 | Alistipes indistinctus | 793551 | 792436 |
| NZ_JH724294.1 | Bacteroides xylanisolvens | 2266288 | 2265140 |
| NZ_PUEO01000011.1 | Bacteroides thetaiotaomicron | 85095 | 83950 |
| NZ_PUEO01000014.1 | Bacteroides thetaiotaomicron | 3708426 | 3709460 |
| NZ_PUEP01000005.1 | Bacteroides ovatus | 1142186 | 1143334 |
| NZ_PUEP01000005.1 | Bacteroides ovatus | 332067 | 331033 |
| NZ_PUEQ01000002.1 | Bacteroides caccae | 334020 | 332995 |
| NZ_PUEQ01000003.1 | Bacteroides caccae | 2119148 | 2118003 |
| NZ_UFTH01000001.1 | Bacteroides fragilis | 2311470 | 2310322 |
| BT_0152 | | 21 | 272 |
| COLAER_01894 | | 110 | 150 |
| CVOZ01000033.1 | Bacteroides thetaiotaomicron | 95414 | 94584 |
| CVOZ01000058.1 | Bacteroides thetaiotaomicron | 56650 | 57405 |
| JGCP01002414.1 | Bacteroides fragilis | 51703 | 52458 |
| NC_000913.3 | Escherichia coli | 3900190 | 3899414 |
| NC_009614.1 | Bacteroides vulgatus | 3187980 | 3188795 |
| NC_009615.1 | Parabacteroides distasonis | 3801163 | 3801933 |
| NC_009615.1 | Parabacteroides distasonis | 2376805 | 2377557 |
| NZ_AAVM02000004.1 | Bacteroides caccae | 216505 | 217236 |
| NZ_ABJL02000007.1 | Bacteroides intestinalis | 250198 | 250920 |
| NZ_ABJL02000008.1 | Bacteroides intestinalis | 1128333 | 1127566 |
| NZ_ABJL02000008.1 | Bacteroides intestinalis | 2507036 | 2506242 |
| NZ_ATFI01000001.1 | Bacteroides cellulosilyticus | 437624 | 437184 |
| NZ_ATFI01000008.1 | Bacteroides cellulosilyticus | 397686 | 398429 |
| NZ_ATFI01000009.1 | Bacteroides cellulosilyticus | 325780 | 324986 |
| NZ_CVOY01000007.1 | Bacteroides thetaiotaomicron | 23231 | 22401 |
| NZ_CVOY01000040.1 | Bacteroides thetaiotaomicron | 78733 | 78002 |
| NZ_DS264541.1 | Parabacteroides merdae | 313243 | 313983 |
| NZ_DS264541.1 | Parabacteroides merdae | 27216 | 26359 |
| NZ_DS264554.1 | Bacteroides ovatus | 368631 | 369470 |
| NZ_DS264554.1 | Bacteroides ovatus | 367127 | 367921 |
| NZ_DS362233.1 | Bacteroides uniformis | 74461 | 73730 |
| NZ_DS362239.1 | Bacteroides uniformis | 7728 | 6928 |
| NZ_DS362239.1 | Bacteroides uniformis | 5156 | 4731 |
| NZ_DS362240.1 | Bacteroides uniformis | 212934 | 213686 |
| NZ_DS499653.1 | Erysipelatoclostridium ramosum | 194977 | 194246 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS499673.1 | Bacteroides stercoris | 206561 | 207376 |
| NZ_DS607663.1 | Providencia stuartii | 1086310 | 1087089 |
| NZ_DS995510.1 | Bacteroides eggerthii | 209097 | 209912 |
| NZ_DS995537.1 | Bacteroides dorei | 626379 | 627194 |
| NZ_DS995537.1 | Bacteroides dorei | 1307678 | 1306917 |
| NZ_DS996440.1 | Parabacteroides johnsonii | 32520 | 31849 |
| NZ_DS996532.1 | Parabacteroides johnsonii | 838 | 98 |
| NZ_DS996921.1 | Bacteroides pectinophilus | 1565854 | 1566558 |
| NZ_EQ973490.1 | Bacteroides cellulosilyticus | 1229269 | 1228547 |
| NZ_EO973490.1 | Bacteroides cellulosilyticus | 549879 | 549439 |
| NZ_EQ973491.1 | Bacteroides cellulosilyticus | 776889 | 777764 |
| NZ_EQ973495.1 | Bacteroides cellulosilyticus | 279325 | 278582 |
| NZ_EQ973651.1 | Bacteroides coprophilus | 37033 | 36287 |
| NZ_GG667608.1 | Hungatella hathewayi | 95800 | 95153 |
| NZ_GG667608.1 | Hungatella hathewayi | 94944 | 94324 |
| NZ_GG688325.1 | Bacteroides finegoldii | 120247 | 120978 |
| NZ_GG704769.1 | Subdoligranulum variabile | 177713 | 178351 |
| NZ_GG705264.1 | Providencia rettgeri | 106827 | 106045 |
| NZ_JGDE01000048.1 | Bacteroides fragilis | 11590 | 12345 |
| NZ_JH370371.1 | Alistipes indistinctus | 55343 | 54528 |
| NZ_JH370371.1 | Alistipes indistinctus | 53836 | 52994 |
| NZ_JH724294.1 | Bacteroides xylanisolvens | 1276334 | 1277065 |
| NZ_KB946519.1 | Enterococcus faecalis | 364107 | 364835 |
| NZ_MTWC01000003.1 | Clostridioides difficile | 2304297 | 2303677 |
| NZ_MTWD01000001.1 | Clostridioides difficile | 2346475 | 2345855 |
| NZ_MTWE01000004.1 | Clostridioides difficile | 2075454 | 2074834 |
| NZ_PUEO01000014.1 | Bacteroides thetaiotaomicron | 1959081 | 1959812 |
| NZ_PUEO01000014.1 | Bacteroides thetaiotaomicron | 843093 | 843923 |
| NZ_PUEP01000005.1 | Bacteroides ovatus | 2224557 | 2223826 |
| NZ_PUEP01000005.1 | Bacteroides ovatus | 5227698 | 5226859 |
| NZ_PUEP01000005.1 | Bacteroides ovatus | 5229202 | 5228408 |
| NZ_PUEQ01000003.1 | Bacteroides caccae | 1833970 | 1833239 |
| NZ_UFTH01000001.1 | Bacteroides fragilis | 3547965 | 3548720 |
| NZ_UFTH01000001.1 | Bacteroides fragilis | 1289092 | 1288223 |
| QEKH01000010.1 | Victivallis vadensis | 10295 | 9546 |
| BACDOR_00571 | | 1 | 175 |
| BT_0217 | | 24 | 198 |
| BT_1006 | | 10 | 78 |
| BT_1148 | | 4 | 168 |
| COLAER_01707 | | 4 | 116 |
| CVOZ01000022.1 | Bacteroides thetaiotaomicron | 96972 | 97520 |
| CVOZ01000044.1 | Bacteroides thetaiotaomicron | 270175 | 270669 |
| CVOZ01000058.1 | Bacteroides thetaiotaomicron | 90345 | 90884 |
| CVOZ01000063.1 | Bacteroides thetaiotaomicron | 213261 | 213785 |
| JGCP01001429.1 | Bacteroides fragilis | 413 | 3 |
| JGCP01002513.1 | Bacteroides fragilis | 8425 | 7883 |
| JGCP01002532.1 | Bacteroides fragilis | 1963 | 1505 |
| NC_000913.3 | Escherichia coli | 891154 | 891663 |
| NC_009614.1 | Bacteroides vulgatus | 3238698 | 3238072 |
| NC_009614.1 | Bacteroides vulgatus | 2553354 | 2553818 |
| NC_009614.1 | Bacteroides vulgatus | 3195978 | 3196472 |
| NC_009614.1 | Bacteroides vulgatus | 1289396 | 1288881 |
| NC_009615.1 | Parabacteroides distasonis | 2044441 | 2044980 |
| NC_009615.1 | Parabacteroides distasonis | 185216 | 184800 |
| NC_009615.1 | Parabacteroides distasonis | 178476 | 179009 |
| NZ_AAVM02000001.1 | Bacteroides caccae | 1119730 | 1119206 |
| NZ_AAVM02000004.1 | Bacteroides caccae | 244889 | 245428 |
| NZ_AAVM02000005.1 | Bacteroides caccae | 238680 | 239204 |
| NZ_AAVM02000006.1 | Bacteroides caccae | 117389 | 117928 |
| NZ_AAXA02000015.1 | Dorea formicigenerans | 812473 | 812982 |
| NZ_AAXA02000015.1 | Dorea formicigenerans | 428131 | 428625 |
| NZ_ABJL02000007.1 | Bacteroides intestinalis | 959684 | 959124 |
| NZ_ABJL02000008.1 | Bacteroides intestinalis | 2984882 | 2985400 |
| NZ_ABJL02000008.1 | Bacteroides intestinalis | 1297560 | 1297051 |
| NZ_ABJL02000008.1 | Bacteroides intestinalis | 1656565 | 1656050 |
| NZ_ACCL02000001.1 | Marvinbryantia formatexigens | 116305 | 116820 |
| NZ_ATFI01000001.1 | Bacteroides cellulosilyticus | 1579965 | 1579402 |
| NZ_ATFI01000002.1 | Bacteroides cellulosilyticus | 1183 | 659 |
| NZ_ATFI01000004.1 | Bacteroides cellulosilyticus | 389835 | 390377 |
| NZ_ATFI01000004.1 | Bacteroides cellulosilyticus | 572189 | 572641 |
| NZ_ATFI01000008.1 | Bacteroides cellulosilyticus | 229474 | 229983 |
| NZ_ATFI01000012.1 | Bacteroides cellulosilyticus | 48939 | 48499 |
| NZ_CVOY01000018.1 | Bacteroides thetaiotaomicron | 29429 | 29977 |
| NZ_CVOY01000040.1 | Bacteroides thetaiotaomicron | 40363 | 39824 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_CVOY01000042.1 | Bacteroides thetaiotaomicron | 62949 | 62425 |
| NZ_CVOY01000048.1 | Bacteroides thetaiotaomicron | 31365 | 31859 |
| NZ_DS264519.1 | Parabacteroides merdae | 6745 | 7230 |
| NZ_DS264542.1 | Parabacteroides merdae | 249165 | 248725 |
| NZ_DS264546.1 | Parabacteroides merdae | 3190 | 2678 |
| NZ_DS264582.1 | Bacteroides ovatus | 368678 | 369202 |
| NZ_DS264583.1 | Bacteroides ovatus | 339955 | 339416 |
| NZ_DS362240.1 | Bacteroides uniformis | 130419 | 130928 |
| NZ_DS362244.1 | Bacteroides uniformis | 170466 | 170960 |
| NZ_DS362248.1 | Bacteroides uniformis | 308142 | 308660 |
| NZ_DS480690.1 | Clostridium bolteae | 89583 | 90038 |
| NZ_DS480690.1 | Clostridium bolteae | 244847 | 244362 |
| NZ_DS480692.1 | Clostridium bolteae | 142221 | 141733 |
| NZ_DS499655.1 | Erysipelatoclostridium ramosum | 354515 | 355036 |
| NZ_DS499657.1 | Erysipelatoclostridium ramosum | 40323 | 39829 |
| NZ_DS499672.1 | Bacteroides stercoris | 113142 | 113645 |
| NZ_DS499673.1 | Bacteroides stercoris | 148946 | 149485 |
| NZ_DS499674.1 | Bacteroides stercoris | 145503 | 146033 |
| NZ_DS499697.1 | Clostridium scindens | 325349 | 325756 |
| NZ_DS499701.1 | Clostridium scindens | 43469 | 43026 |
| NZ_DS562853.1 | Clostridium spiroforme | 140554 | 141075 |
| NZ_DS981517.1 | Clostridium sporogenes | 1671572 | 1672060 |
| NZ_DS981517.1 | Clostridium sporogenes | 2367337 | 2367867 |
| NZ_DS981517.1 | Clostridium sporogenes | 557173 | 557640 |
| NZ_DS981518.1 | Clostridium sporogenes | 1128355 | 1127867 |
| NZ_DS981518.1 | Clostridium sporogenes | 1189238 | 1189765 |
| NZ_DS981518.1 | Clostridium sporogenes | 524044 | 524577 |
| NZ_DS995509.1 | Bacteroides eggerthii | 1232496 | 1232957 |
| NZ_DS995510.1 | Bacteroides eggerthii | 106112 | 106669 |
| NZ_DS995510.1 | Bacteroides eggerthii | 730874 | 731398 |
| NZ_DS995534.1 | Bacteroides dorei | 71649 | 71125 |
| NZ_DS995536.1 | Bacteroides dorei | 38613 | 38149 |
| NZ_DS995537.1 | Bacteroides dorei | 674934 | 674308 |
| NZ_DS995537.1 | Bacteroides dorei | 634373 | 634867 |
| NZ_DS996441.1 | Parabacteroides johnsonii | 40022 | 40534 |
| NZ_DS996445.1 | Parabacteroides johnsonii | 6103 | 6588 |
| NZ_DS996446.1 | Parabacteroides johnsonii | 59146 | 59586 |
| NZ_DS996844.1 | Holdemanella biformis | 9192 | 9704 |
| NZ_DS996847.1 | Holdemanella biformis | 35958 | 36458 |
| NZ_EQ973488.1 | Bacteroides cellulosilyticus | 47287 | 46763 |
| NZ_EQ973490.1 | Bacteroides cellulosilyticus | 1771328 | 1770765 |
| NZ_EQ973491.1 | Bacteroides cellulosilyticus | 190402 | 189860 |
| NZ_EQ973492.1 | Bacteroides cellulosilyticus | 269760 | 270200 |
| NZ_EQ973495.1 | Bacteroides cellulosilyticus | 467156 | 466647 |
| NZ_EQ973650.1 | Bacteroides coprophilus | 309687 | 310124 |
| NZ_EQ973651.1 | Bacteroides coprophilus | 186888 | 186394 |
| NZ_GG657592.1 | Clostridium asparagiforme | 256642 | 256139 |
| NZ_GG657595.1 | Clostridium asparagiforme | 13750 | 13259 |
| NZ_GG662014.1 | Coprococcus comes | 272777 | 273259 |
| NZ_GG667651.1 | Hungatella hathewayi | 1953 | 2384 |
| NZ_GG688331.1 | Bacteroides finegoldii | 31959 | 32501 |
| NZ_GG688334.1 | Bacteroides finegoldii | 50722 | 51141 |
| NZ_GG688343.1 | Bacteroides finegoldii | 10025 | 9501 |
| NZ_GG692723.1 | Roseburia intestinalis | 45117 | 44662 |
| NZ_GG698588.1 | Blautia hansenii | 717359 | 717898 |
| NZ_GG698590.1 | Blautia hansenii | 424894 | 424328 |
| NZ_GG698591.1 | Blautia hansenii | 291854 | 291342 |
| NZ_GG703857.1 | Prevotella copri | 74622 | 74996 |
| NZ_JGDE01000109.1 | Bacteroides fragilis | 17572 | 17084 |
| NZ_JGDE01000119.1 | Bacteroides fragilis | 36868 | 36326 |
| NZ_JGDE01000120.1 | Bacteroides fragilis | 100596 | 100087 |
| NZ_JGDE01000126.1 | Bacteroides fragilis | 19672 | 19214 |
| NZ_JH370371.1 | Alistipes indistinctus | 1207476 | 1206925 |
| NZ_JH724294.1 | Bacteroides xylanisolvens | 1305623 | 1306168 |
| NZ_JH724294.1 | Bacteroides xylanisolvens | 1743280 | 1743804 |
| NZ_JH724297.1 | Bacteroides xylanisolvens | 31681 | 31157 |
| NZ_JH724298.1 | Bacteroides xylanisolvens | 164880 | 165410 |
| NZ_KE993038.1 | Clostridium symbiosum | 28562 | 29077 |
| NZ_MTWC01000003.1 | Clostridioides difficile | 183069 | 182578 |
| NZ_MTWC01000003.1 | Clostridioides difficile | 3694880 | 3694437 |
| NZ_MTWC01000003.1 | Clostridioides difficile | 851750 | 852229 |
| NZ_MTWC01000003.1 | Clostridioides difficile | 764218 | 764397 |
| NZ_MTWD01000001.1 | Clostridioides difficile | 272104 | 271613 |
| NZ_MTWD01000001.1 | Clostridioides difficile | 3699847 | 3699404 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_MTWD01000001.1 | Clostridioides difficile | 951766 | 952245 |
| NZ_MTWD01000001.1 | Clostridioides difficile | 864276 | 864455 |
| NZ_MTWE01000004.1 | Clostridioides difficile | 644539 | 645069 |
| NZ_MTWE01000004.1 | Clostridioides difficile | 3362776 | 3362321 |
| NZ_MTWE01000004.1 | Clostridioides difficile | 562108 | 562287 |
| NZ_MTWF01000010.1 | Clostridioides difficile | 538767 | 539246 |
| NZ_MTWF01000010.1 | Clostridioides difficile | 451166 | 451345 |
| NZ_MTWF01000021.1 | Clostridioides difficile | 734552 | 734109 |
| NZ_PUEM01000006.1 | Clostridium bolteae | 4759215 | 4759670 |
| NZ_PUEM01000006.1 | Clostridium bolteae | 4326854 | 4327342 |
| NZ_PUEM01000006.1 | Clostridium bolteae | 4914475 | 4913990 |
| NZ_PUEO01000014.1 | Bacteroides thetaiotaomicron | 1992590 | 1993129 |
| NZ_PUEO01000014.1 | Bacteroides thetaiotaomicron | 3444721 | 3444197 |
| NZ_PUEO01000014.1 | Bacteroides thetaiotaomicron | 3875031 | 3874483 |
| NZ_PUEO01000014.1 | Bacteroides thetaiotaomicron | 3235794 | 3235300 |
| NZ_PUEP01000005.1 | Bacteroides ovatus | 2195846 | 2195307 |
| NZ_PUEP01000005.1 | Bacteroides ovatus | 164812 | 165351 |
| NZ_PUEP01000005.1 | Bacteroides ovatus | 1680431 | 1679907 |
| NZ_PUEP01000005.1 | Bacteroides ovatus | 683462 | 683986 |
| NZ_PUEQ01000002.1 | Bacteroides caccae | 164447 | 164986 |
| NZ_PUEQ01000002.1 | Bacteroides caccae | 605566 | 606090 |
| NZ_PUEQ01000003.1 | Bacteroides caccae | 1805586 | 1805047 |
| NZ_PUEQ01000003.1 | Bacteroides caccae | 1408541 | 1408017 |
| NZ_UFTH01000001.1 | Bacteroides fragilis | 276153 | 275611 |
| NZ_UFTH01000001.1 | Bacteroides fragilis | 384961 | 384452 |
| NZ_UFTH01000001.1 | Bacteroides fragilis | 627416 | 626958 |
| NZ_UFTH01000002.1 | Bacteroides fragilis | 31630 | 32118 |
| QEKH01000020.1 | Victivallis vadensis | 34973 | 35503 |
| BACDOR_03937 |  | 21 | 270 |
| CVOZ01000033.1 | Bacteroides thetaiotaomicron | 95366 | 94584 |
| CVOZ01000058.1 | Bacteroides thetaiotaomicron | 56629 | 57405 |
| CVOZ01000324.1 | Bacteroides thetaiotaomicron | 70 | 687 |
| JGCP01002414.1 | Bacteroides fragilis | 51709 | 52458 |
| NC_000913.3 | Escherichia coli | 3900130 | 3899411 |
| NC_009614.1 | Bacteroides vulgatus | 3188040 | 3188789 |
| NC_009615.1 | Parabacteroides distasonis | 3801181 | 3801927 |
| NC_009615.1 | Parabacteroides distasonis | 2376805 | 2377560 |
| NC_009615.1 | Parabacteroides distasonis | 3194728 | 3195453 |
| NZ_AAVM02000004.1 | Bacteroides caccae | 216499 | 217236 |
| NZ_ABJL02000001.1 | Bacteroides intestinalis | 92931 | 93386 |
| NZ_ABJL02000007.1 | Bacteroides intestinalis | 250216 | 250953 |
| NZ_ABJL02000007.1 | Bacteroides intestinalis | 251344 | 252009 |
| NZ_ABJL02000007.1 | Bacteroides intestinalis | 167594 | 168043 |
| NZ_ABJL02000008.1 | Bacteroides intestinalis | 1128321 | 1127566 |
| NZ_ABJL02000008.1 | Bacteroides intestinalis | 2507054 | 2506242 |
| NZ_ATFI01000001.1 | Bacteroides cellulosilyticus | 437645 | 436902 |
| NZ_ATFI01000001.1 | Bacteroides cellulosilyticus | 1152160 | 1151711 |
| NZ_ATFI01000006.1 | Bacteroides cellulosilyticus | 51099 | 51554 |
| NZ_ATFI01000008.1 | Bacteroides cellulosilyticus | 397689 | 398429 |
| NZ_ATFI01000009.1 | Bacteroides cellulosilyticus | 325798 | 324986 |
| NZ_CVOY01000007.1 | Bacteroides thetaiotaomicron | 23183 | 22401 |
| NZ_CVOY01000040.1 | Bacteroides thetaiotaomicron | 78754 | 77978 |
| NZ_DS264269.1 | Eubacterium ventriosum | 37509 | 38012 |
| NZ_DS264541.1 | Parabacteroides merdae | 313249 | 313983 |
| NZ_DS264541.1 | Parabacteroides merdae | 27165 | 26368 |
| NZ_DS264554.1 | Bacteroides ovatus | 368625 | 369458 |
| NZ_DS264554.1 | Bacteroides ovatus | 367145 | 367924 |
| NZ_DS362233.1 | Bacteroides uniformis | 74458 | 73727 |
| NZ_DS362239.1 | Bacteroides uniformis | 7728 | 6928 |
| NZ_DS362239.1 | Bacteroides uniformis | 5192 | 4449 |
| NZ_DS362239.1 | Bacteroides uniformis | 6443 | 5691 |
| NZ_DS362240.1 | Bacteroides uniformis | 212961 | 213686 |
| NZ_DS499653.1 | Erysipelatoclostridium ramosum | 194977 | 194246 |
| NZ_DS499673.1 | Bacteroides stercoris | 206600 | 207376 |
| NZ_DS607663.1 | Providencia stuartii | 1086289 | 1086999 |
| NZ_DS995510.1 | Bacteroides eggerthii | 209136 | 209912 |
| NZ_DS995510.1 | Bacteroides eggerthii | 640756 | 640298 |
| NZ_DS995511.1 | Bacteroides eggerthii | 708500 | 707925 |
| NZ_DS995511.1 | Bacteroides eggerthii | 707389 | 706949 |
| NZ_DS995537.1 | Bacteroides dorei | 626439 | 627188 |
| NZ_DS995537.1 | Bacteroides dorei | 1307660 | 1306917 |
| NZ_DS996440.1 | Parabacteroides johnsonii | 32532 | 31852 |
| NZ_DS996532.1 | Parabacteroides johnsonii | 832 | 98 |
| NZ_DS996921.1 | Bacteroides pectinophilus | 1565959 | 1566558 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_EQ973489.1 | *Bacteroides cellulosilyticus* | 600373 | 600828 |
| NZ_EQ973490.1 | *Bacteroides cellulosilyticus* | 549900 | 549157 |
| NZ_EQ973490.1 | *Bacteroides cellulosilyticus* | 1229254 | 1228514 |
| NZ_EQ973490.1 | *Bacteroides cellulosilyticus* | 1339191 | 1338574 |
| NZ_EQ973490.1 | *Bacteroides cellulosilyticus* | 1228123 | 1227458 |
| NZ_EQ973490.1 | *Bacteroides cellulosilyticus* | 1340362 | 1339898 |
| NZ_EQ973490.1 | *Bacteroides cellulosilyticus* | 1351952 | 1351503 |
| NZ_EQ973491.1 | *Bacteroides cellulosilyticus* | 776952 | 777764 |
| NZ_EQ973495.1 | *Bacteroides cellulosilyticus* | 279328 | 278582 |
| NZ_EQ973651.1 | *Bacteroides coprophilus* | 37045 | 36284 |
| NZ_GG667608.1 | *Hungatella hathewayi* | 95881 | 95153 |
| NZ_GG667608.1 | *Hungatella hathewayi* | 95064 | 94324 |
| NZ_GG667610.1 | *Hungatella hathewayi* | 17497 | 18186 |
| NZ_GG688325.1 | *Bacteroides finegoldii* | 120232 | 120978 |
| NZ_GG692718.1 | *Roseburia intestinalis* | 47376 | 46933 |
| NZ_GG704769.1 | *Subdoligranulum variabile* | 177725 | 178351 |
| NZ_GG705264.1 | *Providencia rettgeri* | 106848 | 106150 |
| NZ_JGDE01000048.1 | *Bacteroides fragilis* | 11596 | 12345 |
| NZ_JH370371.1 | *Alistipes indistinctus* | 55352 | 54528 |
| NZ_JH370371.1 | *Alistipes indistinctus* | 53842 | 52994 |
| NZ_JH724294.1 | *Bacteroides xylanisolvens* | 1276319 | 1277065 |
| NZ_KB946519.1 | *Enterococcus faecalis* | 364107 | 364844 |
| NZ_MTWC01000003.1 | *Clostridioides difficile* | 2304288 | 2303677 |
| NZ_MTWD01000001.1 | *Clostridioides difficile* | 2346466 | 2345855 |
| NZ_MTWE01000004.1 | *Clostridioides difficile* | 2075445 | 2074834 |
| NZ_PUEO01000014.1 | *Bacteroides thetaiotaomicron* | 1959060 | 1959836 |
| NZ_PUEO01000014.1 | *Bacteroides thetaiotaomicron* | 843141 | 843923 |
| NZ_PUEP01000005.1 | *Bacteroides ovatus* | 2224578 | 2223826 |
| NZ_PUEP01000005.1 | *Bacteroides ovatus* | 5227704 | 5226871 |
| NZ_PUEP01000005.1 | *Bacteroides ovatus* | 5229184 | 5228405 |
| NZ_PUEQ01000003.1 | *Bacteroides caccae* | 1833976 | 1833239 |
| NZ_UFTH01000001.1 | *Bacteroides fragilis* | 3547971 | 3548720 |
| QEKH01000010.1 | *Victivallis vadensis* | 10220 | 9546 |
| BACDOR_03988 | | 38 | 188 |
| CVOZ01000058.1 | *Bacteroides thetaiotaomicron* | 139616 | 140215 |
| JGCP01002512.1 | *Bacteroides fragilis* | 11361 | 10762 |
| NC_009615.1 | *Parabacteroides distasonis* | 4480120 | 4479551 |
| NC_010655.1 | *Akkermansia muciniphila* | 306289 | 306831 |
| NC_010655.1 | *Akkermansia muciniphila* | 905733 | 906320 |
| NZ_AAVM02000004.1 | *Bacteroides caccae* | 286126 | 286725 |
| NZ_ABJL02000008.1 | *Bacteroides intestinalis* | 1732043 | 1731456 |
| NZ_ATFI01000002.1 | *Bacteroides cellulosilyticus* | 82757 | 82170 |
| NZ_CVOY01000066.1 | *Bacteroides thetaiotaomicron* | 9741 | 10340 |
| NZ_DS264527.1 | *Parabacteroides merdae* | 217241 | 217831 |
| NZ_DS264563.1 | *Bacteroides ovatus* | 4980 | 5579 |
| NZ_DS996456.1 | *Parabacteroides johnsonii* | 597619 | 598122 |
| NZ_EQ973488.1 | *Bacteroides cellulosilyticus* | 180842 | 180255 |
| NZ_GG688325.1 | *Bacteroides finegoldii* | 190680 | 191279 |
| NZ_JGDE01000119.1 | *Bacteroides fragilis* | 11369 | 10770 |
| NZ_JH370372.1 | *Alistipes indistinctus* | 150396 | 149821 |
| NZ_JH724294.1 | *Bacteroides xylanisolvens* | 1356697 | 1357296 |
| NZ_PUEO01000014.1 | *Bacteroides thetaiotaomicron* | 2041862 | 2042461 |
| NZ_PUEP01000005.1 | *Bacteroides ovatus* | 2145744 | 2145145 |
| NZ_PUEQ01000003.1 | *Bacteroides caccae* | 1764349 | 1763750 |
| NZ_UFTH01000001.1 | *Bacteroides fragilis* | 250655 | 250056 |
| QEKH01000037.1 | *Victivallis vadensis* | 41431 | 42000 |
| BT_1192 | | 225 | 462 |
| COLAER_00815 | | 63 | 152 |
| CVOZ01000044.1 | *Bacteroides thetaiotaomicron* | 36179 | 35082 |
| NZ_ABJL02000008.1 | *Bacteroides intestinalis* | 751517 | 750519 |
| NZ_ACCL02000009.1 | *Marvinbryantia formatexigens* | 60051 | 59242 |
| NZ_ATFI01000012.1 | *Bacteroides cellulosilyticus* | 225054 | 224056 |
| NZ_CVOY01000094.1 | *Bacteroides thetaiotaomicron* | 5257 | 4160 |
| NZ_EQ973492.1 | *Bacteroides cellulosilyticus* | 68742 | 69740 |
| NZ_GG693664.1 | *Lactobacillus reuteri* | 69369 | 68959 |
| NZ_GG703857.1 | *Prevotella copri* | 120565 | 119489 |
| NZ_PUEO01000014.1 | *Bacteroides thetaiotaomicron* | 2345451 | 2344354 |
| BACDOR_00665 | | 17 | 220 |
| BT_4075 | | 18 | 237 |
| BT_4096 | | 15 | 233 |
| CVOZ01000033.1 | *Bacteroides thetaiotaomicron* | 61351 | 60695 |
| CVOZ01000033.1 | *Bacteroides thetaiotaomicron* | 99554 | 98895 |
| CVOZ01000053.1 | *Bacteroides thetaiotaomicron* | 57335 | 56628 |
| JGCP01002366.1 | *Bacteroides fragilis* | 7385 | 6810 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| JGCP01002441.1 | *Bacteroides fragilis* | 9886 | 10419 |
| JGCP01002552.1 | *Bacteroides fragilis* | 31062 | 31763 |
| NC_009614.1 | *Bacteroides vulgatus* | 5100285 | 5099674 |
| NC_009615.1 | *Parabacteroides distasonis* | 1134973 | 1135647 |
| NC_009615.1 | *Parabacteroides distasonis* | 3795095 | 3795700 |
| NZ_AAVM02000001.1 | *Bacteroides caccae* | 1240752 | 1240264 |
| NZ_AAYG02000020.1 | *Ruminococcus gnavus* | 146634 | 146014 |
| NZ_ABJL02000006.1 | *Bacteroides intestinalis* | 363959 | 364528 |
| NZ_ATFI01000001.1 | *Bacteroides cellulosilyticus* | 142540 | 143115 |
| NZ_CVOY01000004.1 | *Bacteroides thetaiotaomicron* | 11055 | 11711 |
| NZ_CVOY01000005.1 | *Bacteroides thetaiotaomicron* | 209350 | 210054 |
| NZ_CVOY01000007.1 | *Bacteroides thetaiotaomicron* | 27372 | 26713 |
| NZ_DS264582.1 | *Bacteroides ovatus* | 46805 | 46104 |
| NZ_DS362220.1 | *Bacteroides uniformis* | 17220 | 16552 |
| NZ_DS362220.1 | *Bacteroides uniformis* | 323305 | 322706 |
| NZ_DS362233.1 | *Bacteroides uniformis* | 68158 | 68733 |
| NZ_DS995510.1 | *Bacteroides eggerthii* | 656648 | 657349 |
| NZ_DS995531.1 | *Bacteroides dorei* | 447861 | 448472 |
| NZ_EQ973490.1 | *Bacteroides cellulosilyticus* | 916393 | 917094 |
| NZ_EQ973490.1 | *Bacteroides cellulosilyticus* | 257437 | 258012 |
| NZ_GG688322.1 | *Bacteroides finegoldii* | 129507 | 130208 |
| NZ_JGDE01000017.1 | *Bacteroides fragilis* | 7446 | 6871 |
| NZ_JGDE01000072.1 | *Bacteroides fragilis* | 9365 | 9898 |
| NZ_JGDE01000136.1 | *Bacteroides fragilis* | 27192 | 27893 |
| NZ_JH370372.1 | *Alistipes indistinctus* | 98423 | 97836 |
| NZ_JH724294.1 | *Bacteroides xylanisolvens* | 2429590 | 2428892 |
| NZ_JH724294.1 | *Bacteroides xylanisolvens* | 357558 | 358211 |
| NZ_MTWC01000003.1 | *Clostridioides difficile* | 1624066 | 1624641 |
| NZ_MTWD01000001.1 | *Clostridioides difficile* | 1671881 | 1672456 |
| NZ_MTWE01000004.1 | *Clostridioides difficile* | 1376453 | 1377028 |
| NZ_PUEL01000004.1 | *Ruminococcus gnavus* | 1632369 | 1631749 |
| NZ_PUEO01000014.1 | *Bacteroides thetaiotaomicron* | 2506871 | 2507578 |
| NZ_PUEO01000014.1 | *Bacteroides thetaiotaomicron* | 877155 | 877811 |
| NZ_PUEO01000014.1 | *Bacteroides thetaiotaomicron* | 838952 | 839611 |
| NZ_PUEP01000005.1 | *Bacteroides ovatus* | 917568 | 918269 |
| NZ_PUEQ01000003.1 | *Bacteroides caccae* | 1529561 | 1529073 |
| NZ_UFTH01000001.1 | *Bacteroides fragilis* | 1188601 | 1189302 |
| NZ_UFTH01000001.1 | *Bacteroides fragilis* | 4050588 | 4051193 |
| NZ_UFTH01000001.1 | *Bacteroides fragilis* | 2389555 | 2388980 |
| QEKH01000001.1 | *Victivallis vadensis* | 111269 | 110676 |
| QEKH01000033.1 | *Victivallis vadensis* | 30181 | 29585 |
| BACDOR_03988 | | 47 | 114 |
| BT_1148 | | 1 | 64 |
| COLAER_01707 | | 1 | 61 |
| CVOZ01000045.1 | *Bacteroides thetaiotaomicron* | 71534 | 72259 |
| JGCP01002519.1 | *Bacteroides fragilis* | 4300 | 3575 |
| NC_009614.1 | *Bacteroides vulgatus* | 2641382 | 2642107 |
| NC_009615.1 | *Parabacteroides distasonis* | 3958482 | 3959207 |
| NZ_ABJL02000008.1 | *Bacteroides intestinalis* | 196383 | 195658 |
| NZ_ATFI01000007.1 | *Bacteroides cellulosilyticus* | 165083 | 165808 |
| NZ_CVOY01000055.1 | *Bacteroides thetaiotaomicron* | 66645 | 67370 |
| NZ_EQ973492.1 | *Bacteroides cellulosilyticus* | 685757 | 686482 |
| NZ_JGDE01000121.1 | *Bacteroides fragilis* | 3841 | 3116 |
| NZ_PUEO01000014.1 | *Bacteroides thetaiotaomicron* | 3056168 | 3055443 |
| NZ_UFTH01000001.1 | *Bacteroides fragilis* | 475905 | 475180 |
| BACDOR_00571 | | 1 | 161 |
| BACDOR_03988 | | 38 | 188 |
| BT_1006 | | 1 | 62 |
| COLAER_01707 | | 2 | 173 |
| CVOZ01000022.1 | *Bacteroides thetaiotaomicron* | 97011 | 97409 |
| CVOZ01000044.1 | *Bacteroides thetaiotaomicron* | 270166 | 270732 |
| CVOZ01000058.1 | *Bacteroides thetaiotaomicron* | 90387 | 90851 |
| JGCP01000803.1 | *Bacteroides fragilis* | 3189 | 3539 |
| JGCP01001429.1 | *Bacteroides fragilis* | 368 | 33 |
| JGCP01002451.1 | *Bacteroides fragilis* | 27266 | 27829 |
| JGCP01002513.1 | *Bacteroides fragilis* | 8383 | 8045 |
| JGCP01002532.1 | *Bacteroides fragilis* | 1981 | 1547 |
| NC_000913.3 | *Escherichia coli* | 1848673 | 1848173 |
| NC_009614.1 | *Bacteroides vulgatus* | 1289411 | 1288926 |
| NC_009614.1 | *Bacteroides vulgatus* | 3238587 | 3238135 |
| NC_009614.1 | *Bacteroides vulgatus* | 2553354 | 2553794 |
| NC_009614.1 | *Bacteroides vulgatus* | 3195969 | 3196346 |
| NC_009615.1 | *Parabacteroides distasonis* | 185234 | 184872 |
| NC_009615.1 | *Parabacteroides distasonis* | 2044480 | 2044818 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NC_009615.1 | Parabacteroides distasonis | 178506 | 178946 |
| NC_012781.1 | Eubacterium rectale | 1600351 | 1600812 |
| NZ_AAVM02000001.1 | Bacteroides caccae | 1119739 | 1119173 |
| NZ_AAVM02000004.1 | Bacteroides caccae | 244931 | 245413 |
| NZ_AAVM02000006.1 | Bacteroides caccae | 117419 | 117811 |
| NZ_AAVN02000007.1 | Collinsella aerofaciens | 43331 | 42861 |
| NZ_AAXA02000015.1 | Dorea formicigenerans | 428149 | 428610 |
| NZ_AAXA02000015.1 | Dorea formicigenerans | 92548 | 92081 |
| NZ_AAXA02000015.1 | Dorea formicigenerans | 812479 | 812928 |
| NZ_AAYG02000005.1 | Ruminococcus gnavus | 169541 | 170062 |
| NZ_ABJL02000007.1 | Bacteroides intestinalis | 959657 | 959169 |
| NZ_ABJL02000008.1 | Bacteroides intestinalis | 574722 | 574159 |
| NZ_ABJL02000008.1 | Bacteroides intestinalis | 1297560 | 1297120 |
| NZ_ABJL02000008.1 | Bacteroides intestinalis | 1656580 | 1656089 |
| NZ_ABXA01000011.1 | Anaerococcus hydrogenalis | 17304 | 16843 |
| NZ_ABXA01000037.1 | Anaerococcus hydrogenalis | 15306 | 14824 |
| NZ_ABXW01000046.1 | Providencia alcalifaciens | 53440 | 52970 |
| NZ_ACCL02000007.1 | Marvinbryantia formatexigens | 30293 | 30754 |
| NZ_ACEP01000002.1 | Eubacterium hallii | 34252 | 34719 |
| NZ_ATFI01000001.1 | Bacteroides cellulosilyticus | 1579908 | 1579426 |
| NZ_ATFI01000002.1 | Bacteroides cellulosilyticus | 1189 | 698 |
| NZ_ATFI01000004.1 | Bacteroides cellulosilyticus | 572171 | 572605 |
| NZ_ATFI01000004.1 | Bacteroides cellulosilyticus | 389868 | 390314 |
| NZ_ATFI01000008.1 | Bacteroides cellulosilyticus | 229474 | 229914 |
| NZ_ATFI01000012.1 | Bacteroides cellulosilyticus | 48939 | 48385 |
| NZ_CVOY01000018.1 | Bacteroides thetaiotaomicron | 29468 | 29866 |
| NZ_CVOY01000040.1 | Bacteroides thetaiotaomicron | 40321 | 39857 |
| NZ_CVOY01000048.1 | Bacteroides thetaiotaomicron | 31356 | 31922 |
| NZ_DS264270.1 | Eubacterium ventriosum | 212229 | 212735 |
| NZ_DS264519.1 | Parabacteroides merdae | 6745 | 7185 |
| NZ_DS264542.1 | Parabacteroides merdae | 249186 | 248728 |
| NZ_DS264546.1 | Parabacteroides merdae | 3190 | 2741 |
| NZ_DS264582.1 | Bacteroides ovatus | 368669 | 369235 |
| NZ_DS264583.1 | Bacteroides ovatus | 339925 | 339533 |
| NZ_DS362240.1 | Bacteroides uniformis | 130419 | 130859 |
| NZ_DS362244.1 | Bacteroides uniformis | 170466 | 171023 |
| NZ_DS362248.1 | Bacteroides uniformis | 308148 | 308636 |
| NZ_DS480690.1 | Clostridium bolteae | 244847 | 244389 |
| NZ_DS480690.1 | Clostridium bolteae | 89559 | 89996 |
| NZ_DS480692.1 | Clostridium bolteae | 142191 | 141730 |
| NZ_DS480699.1 | Clostridium bolteae | 65753 | 65265 |
| NZ_DS480702.1 | Clostridium bolteae | 207090 | 207605 |
| NZ_DS499655.1 | Erysipelatoclostridium ramosum | 354515 | 355066 |
| NZ_DS499657.1 | Erysipelatoclostridium ramosum | 40329 | 39883 |
| NZ_DS499659.1 | Erysipelatoclostridium ramosum | 548777 | 548307 |
| NZ_DS499671.1 | Bacteroides stercoris | 218970 | 218503 |
| NZ_DS499672.1 | Bacteroides stercoris | 113148 | 113708 |
| NZ_DS499673.1 | Bacteroides stercoris | 148976 | 149359 |
| NZ_DS499674.1 | Bacteroides stercoris | 145533 | 146009 |
| NZ_DS499697.1 | Clostridium scindens | 325331 | 325762 |
| NZ_DS499701.1 | Clostridium scindens | 43475 | 43014 |
| NZ_DS544193.1 | Anaerotruncus colihominis | 200255 | 200710 |
| NZ_DS562846.1 | Clostridium spiroforme | 146415 | 145894 |
| NZ_DS562853.1 | Clostridium spiroforme | 140554 | 141045 |
| NZ_DS981517.1 | Clostridium sporogenes | 2367337 | 2367828 |
| NZ_DS981517.1 | Clostridium sporogenes | 1671572 | 1672009 |
| NZ_DS981517.1 | Clostridium sporogenes | 557155 | 557655 |
| NZ_DS981518.1 | Clostridium sporogenes | 1189250 | 1189702 |
| NZ_DS990201.1 | Ruminococcus lactaris | 50102 | 50560 |
| NZ_DS995509.1 | Bacteroides eggerthii | 1232487 | 1232954 |
| NZ_DS995510.1 | Bacteroides eggerthii | 730874 | 731431 |
| NZ_DS995510.1 | Bacteroides eggerthii | 106160 | 106552 |
| NZ_DS995511.1 | Bacteroides eggerthii | 244985 | 245470 |
| NZ_DS995534.1 | Bacteroides dorei | 71655 | 71170 |
| NZ_DS995536.1 | Bacteroides dorei | 38613 | 38173 |
| NZ_DS995537.1 | Bacteroides dorei | 674823 | 674371 |
| NZ_DS995537.1 | Bacteroides dorei | 634364 | 634741 |
| NZ_DS996445.1 | Parabacteroides johnsonii | 6103 | 6543 |
| NZ_DS996446.1 | Parabacteroides johnsonii | 59125 | 59583 |
| NZ_DS996841.1 | Holdemanella biformis | 240826 | 240371 |
| NZ_DS996847.1 | Holdemanella biformis | 35961 | 36428 |
| NZ_DS996921.1 | Bacteroides pectinophilus | 1377567 | 1378028 |
| NZ_EQ973488.1 | Bacteroides cellulosilyticus | 47293 | 46802 |
| NZ_EQ973490.1 | Bacteroides cellulosilyticus | 1771271 | 1770789 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_EQ973491.1 | Bacteroides cellulosilyticus | 190369 | 189923 |
| NZ_EQ973492.1 | Bacteroides cellulosilyticus | 269760 | 270314 |
| NZ_EQ973495.1 | Bacteroides cellulosilyticus | 467156 | 466716 |
| NZ_EQ973631.1 | Bacteroides coprophilus | 166054 | 166542 |
| NZ_EQ973635.1 | Bacteroides coprophilus | 157971 | 157459 |
| NZ_EQ973650.1 | Bacteroides coprophilus | 309687 | 310166 |
| NZ_EQ973651.1 | Bacteroides coprophilus | 186897 | 186505 |
| NZ_GG657592.1 | Clostridium asparagiforme | 256642 | 256181 |
| NZ_GG657592.1 | Clostridium asparagiforme | 2004031 | 2003507 |
| NZ_GG662012.1 | Coprococcus comes | 43447 | 42971 |
| NZ_GG662014.1 | Coprococcus comes | 263238 | 263699 |
| NZ_GG662014.1 | Coprococcus comes | 272789 | 273202 |
| NZ_GG667651.1 | Hungatella hathewayi | 1938 | 2414 |
| NZ_GG667669.1 | Hungatella hathewayi | 6018 | 5659 |
| NZ_GG688323.1 | Bacteroides finegoldii | 185586 | 185020 |
| NZ_GG688331.1 | Bacteroides finegoldii | 31992 | 32390 |
| NZ_GG688334.1 | Bacteroides finegoldii | 50704 | 51138 |
| NZ_GG688343.1 | Bacteroides finegoldii | 10043 | 9534 |
| NZ_GG692721.1 | Roseburia intestinalis | 15570 | 16028 |
| NZ_GG692723.1 | Roseburia intestinalis | 45141 | 44704 |
| NZ_GG698588.1 | Blautia hansenii | 717392 | 717745 |
| NZ_GG698590.1 | Blautia hansenii | 424876 | 424454 |
| NZ_GG698591.1 | Blautia hansenii | 291860 | 291414 |
| NZ_GG703859.1 | Prevotella copri | 138304 | 138762 |
| NZ_GG704769.1 | Subdoligranulum variabile | 1245795 | 1245319 |
| NZ_GG704863.1 | Enterobacter cancerogenus | 743021 | 743521 |
| NZ_GG705262.1 | Providencia rettgeri | 266718 | 267200 |
| NZ_JGDE01000083.1 | Bacteroides fragilis | 52773 | 53336 |
| NZ_JGDE01000119.1 | Bacteroides fragilis | 36826 | 36488 |
| NZ_JGDE01000120.1 | Bacteroides fragilis | 100596 | 100204 |
| NZ_JGDE01000126.1 | Bacteroides fragilis | 19690 | 19256 |
| NZ_JH370371.1 | Alistipes indistinctus | 1289797 | 1289312 |
| NZ_JH724294.1 | Bacteroides xylanisolvens | 1743271 | 1743837 |
| NZ_JH724294.1 | Bacteroides xylanisolvens | 1305671 | 1306153 |
| NZ_JH724298.1 | Bacteroides xylanisolvens | 164868 | 165341 |
| NZ_KE993038.1 | Clostridium symbiosum | 28568 | 29044 |
| NZ_MTWC01000003.1 | Clostridioides difficile | 764209 | 764835 |
| NZ_MTWC01000003.1 | Clostridioides difficile | 851741 | 852184 |
| NZ_MTWC01000003.1 | Clostridioides difficile | 2732784 | 2732185 |
| NZ_MTWC01000003.1 | Clostridioides difficile | 699115 | 699672 |
| NZ_MTWC01000003.1 | Clostridioides difficile | 183072 | 182623 |
| NZ_MTWC01000003.1 | Clostridioides difficile | 3541722 | 3542282 |
| NZ_MTWD01000001.1 | Clostridioides difficile | 864267 | 864893 |
| NZ_MTWD01000001.1 | Clostridioides difficile | 951757 | 952200 |
| NZ_MTWD01000001.1 | Clostridioides difficile | 2768710 | 2768111 |
| NZ_MTWD01000001.1 | Clostridioides difficile | 797509 | 798066 |
| NZ_MTWD01000001.1 | Clostridioides difficile | 272107 | 271658 |
| NZ_MTWD01000001.1 | Clostridioides difficile | 3546771 | 3547331 |
| NZ_MTWE01000004.1 | Clostridioides difficile | 3086150 | 3086647 |
| NZ_MTWE01000004.1 | Clostridioides difficile | 644551 | 645006 |
| NZ_MTWE01000004.1 | Clostridioides difficile | 562099 | 562725 |
| NZ_MTWE01000004.1 | Clostridioides difficile | 2485446 | 2484847 |
| NZ_MTWE01000004.1 | Clostridioides difficile | 496166 | 496723 |
| NZ_MTWE01000004.1 | Clostridioides difficile | 3212349 | 3212909 |
| NZ_MTWF01000010.1 | Clostridioides difficile | 451157 | 451783 |
| NZ_MTWF01000010.1 | Clostridioides difficile | 538758 | 539201 |
| NZ_MTWF01000010.1 | Clostridioides difficile | 384824 | 385381 |
| NZ_MTWF01000021.1 | Clostridioides difficile | 587932 | 588492 |
| NZ_PPUH01000002.1 | Eggerthella lenta | 235526 | 235999 |
| NZ_PUEL01000004.1 | Ruminococcus gnavus | 215279 | 214758 |
| NZ_PUEM01000006.1 | Clostridium bolteae | 4914475 | 4914017 |
| NZ_PUEM01000006.1 | Clostridium bolteae | 4326884 | 4327345 |
| NZ_PUEM01000006.1 | Clostridium bolteae | 105784 | 105296 |
| NZ_PUEM01000006.1 | Clostridium bolteae | 4759191 | 4759628 |
| NZ_PUEM01000006.1 | Clostridium bolteae | 3928704 | 3928189 |
| NZ_PUEO01000014.1 | Bacteroides thetaiotaomicron | 3235803 | 3235237 |
| NZ_PUEO01000014.1 | Bacteroides thetaiotaomicron | 3874992 | 3874594 |
| NZ_PUEO01000014.1 | Bacteroides thetaiotaomicron | 1992632 | 1993096 |
| NZ_PUEP01000005.1 | Bacteroides ovatus | 1680440 | 1679874 |
| NZ_PUEP01000005.1 | Bacteroides ovatus | 2195804 | 2195322 |
| NZ_PUEP01000005.1 | Bacteroides ovatus | 164842 | 165234 |
| NZ_PUEP01000005.1 | Bacteroides ovatus | 562300 | 561950 |
| NZ_PUEQ01000002.1 | Bacteroides caccae | 164477 | 164869 |
| NZ_PUEQ01000003.1 | Bacteroides caccae | 1408550 | 1407984 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_PUEQ01000003.1 | *Bacteroides caccae* | 1805544 | 1805062 |
| NZ_UFTH01000001.1 | *Bacteroides fragilis* | 4377465 | 4378028 |
| NZ_UFTH01000001.1 | *Bacteroides fragilis* | 384961 | 384569 |
| NZ_UFTH01000001.1 | *Bacteroides fragilis* | 276111 | 275773 |
| NZ_UFTH01000001.1 | *Bacteroides fragilis* | 627434 | 627000 |
| QEKH01000007.1 | *Victivallis vadensis* | 148157 | 147966 |
| QEKH01000020.1 | *Victivallis vadensis* | 34991 | 35440 |
| BACDOR_03642 | | 199 | 294 |
| BT_0445 | | 108 | 355 |
| BT_3112 | | 198 | 273 |
| BT_4096 | | 25 | 227 |
| COLAER_00311 | | 4 | 141 |
| COLAER_01894 | | 100 | 223 |
| CVOZ01000002.1 | *Bacteroides thetaiotaomicron* | 27517 | 28095 |
| CVOZ01000022.1 | *Bacteroides thetaiotaomicron* | 18764 | 19381 |
| CVOZ01000033.1 | *Bacteroides thetaiotaomicron* | 94159 | 93596 |
| CVOZ01000044.1 | *Bacteroides thetaiotaomicron* | 154575 | 155963 |
| CVOZ01000044.1 | *Bacteroides thetaiotaomicron* | 288279 | 287539 |
| CVOZ01000044.1 | *Bacteroides thetaiotaomicron* | 54111 | 54704 |
| CVOZ01000045.1 | *Bacteroides thetaiotaomicron* | 69771 | 70430 |
| JGCP01000579.1 | *Bacteroides fragilis* | 101 | 835 |
| JGCP01001396.1 | *Bacteroides fragilis* | 73 | 648 |
| JGCP01001597.1 | *Bacteroides fragilis* | 35746 | 35105 |
| JGCP01001863.1 | *Bacteroides fragilis* | 3013 | 2438 |
| JGCP01002141.1 | *Bacteroides fragilis* | 80 | 562 |
| JGCP01002441.1 | *Bacteroides fragilis* | 10488 | 11063 |
| JGCP01002451.1 | *Bacteroides fragilis* | 42494 | 41802 |
| JGCP01002459.1 | *Bacteroides fragilis* | 73942 | 74622 |
| NC_008618.1 | *Bifidobacterium adolescentis* | 551869 | 551261 |
| NC_008618.1 | *Bifidobacterium adolescentis* | 1949407 | 1950006 |
| NC_009614.1 | *Bacteroides vulgatus* | 768330 | 769709 |
| NC_009614.1 | *Bacteroides vulgatus* | 3519215 | 3518526 |
| NC_009614.1 | *Bacteroides vulgatus* | 5099605 | 5099030 |
| NC_009615.1 | *Parabacteroides distasonis* | 2089648 | 2090340 |
| NC_009615.1 | *Parabacteroides distasonis* | 3529426 | 3530001 |
| NC_009615.1 | *Parabacteroides distasonis* | 421342 | 422067 |
| NC_010655.1 | *Akkermansia muciniphila* | 236748 | 237500 |
| NC_010655.1 | *Akkermansia muciniphila* | 1519934 | 1520518 |
| NC_010655.1 | *Akkermansia muciniphila* | 543429 | 544073 |
| NZ_AAVM02000001.1 | *Bacteroides caccae* | 1170612 | 1169452 |
| NZ_AAVM02000001.1 | *Bacteroides caccae* | 1240152 | 1239577 |
| NZ_AAVM02000001.1 | *Bacteroides caccae* | 1169494 | 1169237 |
| NZ_AAVN02000002.1 | *Collinsella aerofaciens* | 333786 | 333019 |
| NZ_AAVN02000003.1 | *Collinsella aerofaciens* | 209264 | 210085 |
| NZ_AAXA02000013.1 | *Dorea formicigenerans* | 16343 | 17014 |
| NZ_ABJL02000007.1 | *Bacteroides intestinalis* | 1098860 | 1099444 |
| NZ_ABJL02000008.1 | *Bacteroides intestinalis* | 382787 | 383479 |
| NZ_ACCL02000033.1 | *Marvinbryantia formatexigens* | 12876 | 12274 |
| NZ_ATFI01000001.1 | *Bacteroides cellulosilyticus* | 1683794 | 1684420 |
| NZ_ATFI01000001.1 | *Bacteroides cellulosilyticus* | 1683052 | 1683747 |
| NZ_ATFI01000001.1 | *Bacteroides cellulosilyticus* | 1782879 | 1783463 |
| NZ_ATFI01000001.1 | *Bacteroides cellulosilyticus* | 1678134 | 1678772 |
| NZ_ATFI01000003.1 | *Bacteroides cellulosilyticus* | 171894 | 171202 |
| NZ_CVOY01000007.1 | *Bacteroides thetaiotaomicron* | 21976 | 21413 |
| NZ_CVOY01000035.1 | *Bacteroides thetaiotaomicron* | 60758 | 62146 |
| NZ_CVOY01000041.1 | *Bacteroides thetaiotaomicron* | 67133 | 66540 |
| NZ_CVOY01000048.1 | *Bacteroides thetaiotaomicron* | 49341 | 48601 |
| NZ_CVOY01000055.1 | *Bacteroides thetaiotaomicron* | 64881 | 65540 |
| NZ_CVOY01000056.1 | *Bacteroides thetaiotaomicron* | 28539 | 27919 |
| NZ_DS264285.1 | *Eubacterium ventriosum* | 234482 | 233679 |
| NZ_DS264345.1 | *Ruminococcus torques* | 463345 | 463708 |
| NZ_DS264358.1 | *Ruminococcus torques* | 67993 | 67382 |
| NZ_DS264461.1 | *Parabacteroides merdae* | 326010 | 326663 |
| NZ_DS264517.1 | *Parabacteroides merdae* | 22263 | 22925 |
| NZ_DS264542.1 | *Parabacteroides merdae* | 81508 | 82206 |
| NZ_DS264546.1 | *Parabacteroides merdae* | 423018 | 422293 |
| NZ_DS264582.1 | *Bacteroides ovatus* | 312464 | 313840 |
| NZ_DS264582.1 | *Bacteroides ovatus* | 385872 | 385138 |
| NZ_DS264584.1 | *Bacteroides ovatus* | 360662 | 360078 |
| NZ_DS362246.1 | *Bacteroides uniformis* | 266126 | 266818 |
| NZ_DS480676.1 | *Clostridium bolteae* | 34484 | 35167 |
| NZ_DS499671.1 | *Bacteroides stercoris* | 178076 | 178768 |
| NZ_DS499699.1 | *Clostridium scindens* | 152903 | 153694 |
| NZ_DS990204.1 | *Ruminococcus lactaris* | 12440 | 11805 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS990238.1 | Bifidobacterium longum | 835334 | 835945 |
| NZ_DS995510.1 | Bacteroides eggerthii | 1068518 | 1069210 |
| NZ_DS995531.1 | Bacteroides dorei | 448541 | 449116 |
| NZ_DS995532.1 | Bacteroides dorei | 204439 | 203063 |
| NZ_DS995537.1 | Bacteroides dorei | 1066363 | 1065647 |
| NZ_DS996444.1 | Parabacteroides johnsonii | 692206 | 692904 |
| NZ_DS996444.1 | Parabacteroides johnsonii | 534772 | 535347 |
| NZ_DS996445.1 | Parabacteroides johnsonii | 312362 | 312937 |
| NZ_DS996445.1 | Parabacteroides johnsonii | 311498 | 312121 |
| NZ_DS996453.1 | Parabacteroides johnsonii | 2533 | 1928 |
| NZ_DS996454.1 | Parabacteroides johnsonii | 206111 | 205386 |
| NZ_DS996921.1 | Bacteroides pectinophilus | 286605 | 285892 |
| NZ_DS996921.1 | Bacteroides pectinophilus | 2101527 | 2100832 |
| NZ_EQ973490.1 | Bacteroides cellulosilyticus | 1876241 | 1876867 |
| NZ_EQ973490.1 | Bacteroides cellulosilyticus | 1875499 | 1876194 |
| NZ_EQ973490.1 | Bacteroides cellulosilyticus | 1993710 | 1994294 |
| NZ_EQ973490.1 | Bacteroides cellulosilyticus | 1870581 | 1871219 |
| NZ_EQ973492.1 | Bacteroides cellulosilyticus | 515707 | 515015 |
| NZ_EQ973635.1 | Bacteroides coprophilus | 234153 | 233497 |
| NZ_EQ973643.1 | Bacteroides coprophilus | 430594 | 431154 |
| NZ_EQ973645.1 | Bacteroides coprophilus | 64093 | 64677 |
| NZ_GG657587.1 | Clostridium asparagiforme | 608304 | 607693 |
| NZ_GG688324.1 | Bacteroides finegoldii | 240097 | 241473 |
| NZ_GG692719.1 | Roseburia intestinalis | 133882 | 133238 |
| NZ_GG692722.1 | Roseburia intestinalis | 102286 | 101618 |
| NZ_GG698591.1 | Blautia hansenii | 190916 | 190320 |
| NZ_GG703852.1 | Prevotella copri | 38955 | 39719 |
| NZ_GG704769.1 | Subdoligranulum variabile | 1468443 | 1469039 |
| NZ_JGDE01000072.1 | Bacteroides fragilis | 9967 | 10542 |
| NZ_JGDE01000083.1 | Bacteroides fragilis | 68003 | 67311 |
| NZ_JGDE01000090.1 | Bacteroides fragilis | 28577 | 29257 |
| NZ_JGDE01000151.1 | Bacteroides fragilis | 44141 | 43500 |
| NZ_JH370371.1 | Alistipes indistinctus | 1345780 | 1345082 |
| NZ_JH370371.1 | Alistipes indistinctus | 1448027 | 1447329 |
| NZ_JH370371.1 | Alistipes indistinctus | 1079496 | 1078762 |
| NZ_JH370372.1 | Alistipes indistinctus | 982398 | 983033 |
| NZ_JH724294.1 | Bacteroides xylanisolvens | 1686417 | 1687793 |
| NZ_JH724294.1 | Bacteroides xylanisolvens | 1760534 | 1759800 |
| NZ_JH724300.1 | Bacteroides xylanisolvens | 30471 | 31202 |
| NZ_PUEL01000004.1 | Ruminococcus gnavus | 1481589 | 1480987 |
| NZ_PUEM01000006.1 | Clostridium bolteae | 1700445 | 1699762 |
| NZ_PUEO01000004.1 | Bacteroides thetaiotaomicron | 234534 | 233911 |
| NZ_PUEO01000004.1 | Bacteroides thetaiotaomicron | 909823 | 909245 |
| NZ_PUEO01000014.1 | Bacteroides thetaiotaomicron | 3291162 | 3289774 |
| NZ_PUEO01000014.1 | Bacteroides thetaiotaomicron | 3176085 | 3176825 |
| NZ_PUEO01000014.1 | Bacteroides thetaiotaomicron | 3057931 | 3057272 |
| NZ_PUEO01000014.1 | Bacteroides thetaiotaomicron | 844348 | 844911 |
| NZ_PUEO01000014.1 | Bacteroides thetaiotaomicron | 2363382 | 2363975 |
| NZ_PUEO01000014.1 | Bacteroides thetaiotaomicron | 3953243 | 3952623 |
| NZ_PUEP01000005.1 | Bacteroides ovatus | 1736646 | 1735270 |
| NZ_PUEP01000005.1 | Bacteroides ovatus | 1663236 | 1663970 |
| NZ_PUEP01000005.1 | Bacteroides ovatus | 3085087 | 3085671 |
| NZ_PUEQ01000003.1 | Bacteroides caccae | 1459423 | 1458263 |
| NZ_PUEQ01000003.1 | Bacteroides caccae | 1528961 | 1528386 |
| NZ_PUEQ01000003.1 | Bacteroides caccae | 1458305 | 1458048 |
| NZ_UFTH01000001.1 | Bacteroides fragilis | 4392695 | 4392003 |
| NZ_UFTH01000001.1 | Bacteroides fragilis | 1560134 | 1559493 |
| NZ_UFTH01000001.1 | Bacteroides fragilis | 4539896 | 4540576 |
| NZ_UFTH01000001.1 | Bacteroides fragilis | 4051262 | 4051837 |
| QEKH01000002.1 | Victivallis vadensis | 212329 | 213045 |
| QEKH01000007.1 | Victivallis vadensis | 28585 | 27923 |
| QEKH01000045.1 | Victivallis vadensis | 12920 | 13444 |
| QEKH01000049.1 | Victivallis vadensis | 19550 | 18807 |
| CVOZ01000063.1 | Bacteroides thetaiotaomicron | 94029 | 94442 |
| CVOZ01000063.1 | Bacteroides thetaiotaomicron | 147334 | 147705 |
| JGCP01000058.1 | Bacteroides fragilis | 518 | 925 |
| JGCP01002489.1 | Bacteroides fragilis | 518 | 925 |
| JGCP01002505.1 | Bacteroides fragilis | 555 | 148 |
| NC_009614.1 | Bacteroides vulgatus | 910468 | 910875 |
| NC_009615.1 | Parabacteroides distasonis | 2405517 | 2405906 |
| NZ_AAVM02000005.1 | Bacteroides caccae | 97107 | 97520 |
| NZ_AAVM02000005.1 | Bacteroides caccae | 155081 | 155452 |
| NZ_ABJL02000008.1 | Bacteroides intestinalis | 642857 | 643258 |
| NZ_ABJL02000008.1 | Bacteroides intestinalis | 2029709 | 2030089 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_ABJL02000008.1 | Bacteroides intestinalis | 1716117 | 1715746 |
| NZ_ATFI01000002.1 | Bacteroides cellulosilyticus | 74483 | 74112 |
| NZ_ATFI01000012.1 | Bacteroides cellulosilyticus | 122628 | 123029 |
| NZ_CVOY01000013.1 | Bacteroides thetaiotaomicron | 191727 | 192140 |
| NZ_CVOY01000058.1 | Bacteroides thetaiotaomicron | 28964 | 28593 |
| NZ_DS264541.1 | Parabacteroides merdae | 67177 | 66776 |
| NZ_DS362236.1 | Bacteroides uniformis | 38489 | 38878 |
| NZ_DS362245.1 | Bacteroides uniformis | 24062 | 24184 |
| NZ_DS362245.1 | Bacteroides uniformis | 24267 | 24356 |
| NZ_DS362245.1 | Bacteroides uniformis | 24193 | 24264 |
| NZ_DS480694.1 | Clostridium bolteae | 252033 | 252386 |
| NZ_DS499718.1 | Clostridium scindens | 309983 | 309654 |
| NZ_DS995528.1 | Bacteroides dorei | 127411 | 127812 |
| NZ_DS995533.1 | Bacteroides dorei | 131728 | 131327 |
| NZ_DS996447.1 | Parabacteroides johnsonii | 92123 | 91722 |
| NZ_DS996455.1 | Parabacteroides johnsonii | 41510 | 41118 |
| NZ_DS996455.1 | Parabacteroides johnsonii | 41091 | 40711 |
| NZ_EQ973488.1 | Bacteroides cellulosilyticus | 155148 | 154777 |
| NZ_EQ973492.1 | Bacteroides cellulosilyticus | 200913 | 200512 |
| NZ_GG657592.1 | Clostridium asparagiforme | 560671 | 561042 |
| NZ_GG667665.1 | Hungatella hathewayi | 3412 | 3059 |
| NZ_GG688317.1 | Bacteroides finegoldii | 373129 | 372716 |
| NZ_GG688317.1 | Bacteroides finegoldii | 351401 | 351003 |
| NZ_JGDE01000115.1 | Bacteroides fragilis | 2024 | 1617 |
| NZ_JH370371.1 | Alistipes indistinctus | 1113682 | 1114062 |
| NZ_JH724297.1 | Bacteroides xylanisolvens | 171556 | 171143 |
| NZ_JH724227.1 | Bacteroides xylanisolvens | 107147 | 106856 |
| NZ_PUEM01000006.1 | Clostridium bolteae | 5784734 | 5784381 |
| NZ_AAVN02000003.1 | Collinsella aerofaciens | 209264 | 210085 |
| NZ_AAXA02000013.1 | Dorea formicigenerans | 16343 | 17014 |
| NZ_ABJL02000007.1 | Bacteroides intestinalis | 1098860 | 1099444 |
| NZ_ABJL02000008.1 | Bacteroides intestinalis | 382787 | 383479 |
| NZ_ACCL02000033.1 | Marvinbryantia formatexigens | 12876 | 12274 |
| NZ_ATFI01000001.1 | Bacteroides cellulosilyticus | 1683794 | 1684420 |
| NZ_ATFI01000001.1 | Bacteroides cellulosilyticus | 1683052 | 1683747 |
| NZ_ATFI01000001.1 | Bacteroides cellulosilyticus | 1782879 | 1783463 |
| NZ_ATFI01000001.1 | Bacteroides cellulosilyticus | 1678134 | 1678772 |
| NZ_ATFI01000003.1 | Bacteroides cellulosilyticus | 171894 | 171202 |
| NZ_CVOY01000007.1 | Bacteroides thetaiotaomicron | 21976 | 21413 |
| NZ_CVOY01000035.1 | Bacteroides thetaiotaomicron | 60758 | 62146 |
| NZ_CVOY01000041.1 | Bacteroides thetaiotaomicron | 67133 | 66540 |
| NZ_CVOY01000048.1 | Bacteroides thetaiotaomicron | 49341 | 48601 |
| NZ_CVOY01000055.1 | Bacteroides thetaiotaomicron | 64881 | 65540 |
| NZ_CVOY01000056.1 | Bacteroides thetaiotaomicron | 28539 | 27919 |
| NZ_DS264285.1 | Eubacterium ventriosum | 234482 | 233679 |
| NZ_DS264345.1 | Ruminococcus torques | 463019 | 463708 |
| NZ_DS264358.1 | Ruminococcus torques | 67993 | 67382 |
| NZ_DS264461.1 | Parabacteroides merdae | 326010 | 326663 |
| NZ_DS264517.1 | Parabacteroides merdae | 22263 | 22925 |
| NZ_DS264542.1 | Parabacteroides merdae | 81508 | 82206 |
| NZ_DS264546.1 | Parabacteroides merdae | 423018 | 422293 |
| NZ_DS264582.1 | Bacteroides ovatus | 312464 | 313840 |
| NZ_DS264582.1 | Bacteroides ovatus | 385872 | 385138 |
| NZ_DS264584.1 | Bacteroides ovatus | 360662 | 360078 |
| NZ_DS362246.1 | Bacteroides uniformis | 266126 | 266818 |
| NZ_DS480676.1 | Clostridium bolteae | 34484 | 35167 |
| NZ_DS499671.1 | Bacteroides stercoris | 178076 | 178768 |
| NZ_DS499699.1 | Clostridium scindens | 152903 | 153694 |
| NZ_DS990204.1 | Ruminococcus lactaris | 12440 | 11805 |
| NZ_DS990238.1 | Bifidobacterium longum | 835334 | 835945 |
| NZ_DS995510.1 | Bacteroides eggerthii | 1068510 | 1069210 |
| NZ_DS995531.1 | Bacteroides dorei | 448541 | 449116 |
| NZ_DS995532.1 | Bacteroides dorei | 204439 | 203063 |
| NZ_DS995537.1 | Bacteroides dorei | 1066363 | 1065647 |
| NZ_DS996444.1 | Parabacteroides johnsonii | 692206 | 692904 |
| NZ_DS996444.1 | Parabacteroides johnsonii | 534772 | 535347 |
| NZ_DS996445.1 | Parabacteroides johnsonii | 312362 | 312937 |
| NZ_DS996445.1 | Parabacteroides johnsonii | 311498 | 312121 |
| NZ_DS996453.1 | Parabacteroides johnsonii | 2533 | 1928 |
| NZ_DS996454.1 | Parabacteroides johnsonii | 206111 | 205386 |
| NZ_DS996921.1 | Bacteroides pectinophilus | 286605 | 285892 |
| NZ_DS996921.1 | Bacteroides pectinophilus | 2101527 | 2100832 |
| NZ_EQ973490.1 | Bacteroides cellulosilyticus | 1876241 | 1876867 |
| NZ_EQ973490.1 | Bacteroides cellulosilyticus | 1875499 | 1876194 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_EQ973490.1 | Bacteroides cellulosilyticus | 1993710 | 1994294 |
| NZ_EQ973490.1 | Bacteroides cellulosilyticus | 1870581 | 1871219 |
| NZ_EQ973492.1 | Bacteroides cellulosilyticus | 515707 | 515015 |
| NZ_EQ973635.1 | Bacteroides coprophilus | 234153 | 233497 |
| NZ_EQ973643.1 | Bacteroides coprophilus | 430594 | 431154 |
| NZ_EQ973645.1 | Bacteroides coprophilus | 64093 | 64677 |
| NZ_GG657587.1 | Clostridium asparagiforme | 608304 | 607693 |
| NZ_GG688324.1 | Bacteroides finegoldii | 240097 | 241473 |
| NZ_GG692719.1 | Roseburia intestinalis | 133882 | 133238 |
| NZ_GG692722.1 | Roseburia intestinalis | 102286 | 101618 |
| NZ_GG698591.1 | Blautia hansenii | 190916 | 190320 |
| NZ_GG703852.1 | Prevotella copri | 38955 | 39719 |
| NZ_GG704769.1 | Subdoligranulum variabile | 1468443 | 1469039 |
| NZ_JGDE01000072.1 | Bacteroides fragilis | 9967 | 10542 |
| NZ_JGDE01000083.1 | Bacteroides fragilis | 68003 | 67311 |
| NZ_JGDE01000090.1 | Bacteroides fragilis | 28577 | 29257 |
| NZ_JGDE01000151.1 | Bacteroides fragilis | 44141 | 43500 |
| NZ_JH370371.1 | Alistipes indistinctus | 1345780 | 1345082 |
| NZ_JH370371.1 | Alistipes indistinctus | 1448027 | 1447329 |
| NZ_JH370371.1 | Alistipes indistinctus | 1079496 | 1078762 |
| NZ_JH370372.1 | Alistipes indistinctus | 982398 | 983033 |
| NZ_JH724294.1 | Bacteroides xylanisolvens | 1686417 | 1687793 |
| NZ_JH724294.1 | Bacteroides xylanisolvens | 1760534 | 1759800 |
| NZ_JH724300.1 | Bacteroides xylanisolvens | 30471 | 31202 |
| NZ_PUEL01000004.1 | Ruminococcus gnavus | 1481589 | 1480987 |
| NZ_PUEM01000006.1 | Clostridium bolteae | 1700445 | 1699762 |
| NZ_PUEO01000004.1 | Bacteroides thetaiotaomicron | 234534 | 233911 |
| NZ_PUEO01000004.1 | Bacteroides thetaiotaomicron | 909823 | 909245 |
| NZ_PUEO01000014.1 | Bacteroides thetaiotaomicron | 3291162 | 3289774 |
| NZ_PUEO01000014.1 | Bacteroides thetaiotaomicron | 3176085 | 3176825 |
| NZ_PUEO01000014.1 | Bacteroides thetaiotaomicron | 3057931 | 3057272 |
| NZ_PUEO01000014.1 | Bacteroides thetaiotaomicron | 844348 | 844911 |
| NZ_PUEO01000014.1 | Bacteroides thetaiotaomicron | 2363382 | 2363975 |
| NZ_PUEO01000014.1 | Bacteroides thetaiotaomicron | 3953243 | 3952623 |
| NZ_PUEP01000005.1 | Bacteroides ovatus | 1736646 | 1735270 |
| NZ_PUEP01000005.1 | Bacteroides ovatus | 1663236 | 1663970 |
| NZ_PUEP01000005.1 | Bacteroides ovatus | 3085087 | 3085671 |
| NZ_PUEQ01000003.1 | Bacteroides caccae | 1459423 | 1458263 |
| NZ_PUEQ01000003.1 | Bacteroides caccae | 1528961 | 1528386 |
| NZ_PUEQ01000003.1 | Bacteroides caccae | 1458305 | 1458048 |
| NZ_UFTH01000001.1 | Bacteroides fragilis | 4392695 | 4392003 |
| NZ_UFTH01000001.1 | Bacteroides fragilis | 1560134 | 1559493 |
| NZ_UFTH01000001.1 | Bacteroides fragilis | 4539896 | 4540576 |
| NZ_UFTH01000001.1 | Bacteroides fragilis | 4051262 | 4051837 |
| QEKH01000002.1 | Victivallis vadensis | 212329 | 213045 |
| QEKH01000007.1 | Victivallis vadensis | 28585 | 27923 |
| QEKH01000045.1 | Victivallis vadensis | 12920 | 13444 |
| QEKH01000049.1 | Victivallis vadensis | 19550 | 18807 |
| CVOZ01000063.1 | Bacteroides thetaiotaomicron | 94029 | 94442 |
| CVOZ01000063.1 | Bacteroides thetaiotaomicron | 147334 | 147705 |
| JGCP01000058.1 | Bacteroides fragilis | 518 | 925 |
| JGCP01002489.1 | Bacteroides fragilis | 518 | 925 |
| JGCP01002505.1 | Bacteroides fragilis | 555 | 148 |
| NC_009614.1 | Bacteroides vulgatus | 910468 | 910875 |
| NC_009615.1 | Parabacteroides distasonis | 2405517 | 2405906 |
| NZ_AAVM02000005.1 | Bacteroides caccae | 97107 | 97520 |
| NZ_AAVM02000005.1 | Bacteroides caccae | 155081 | 155452 |
| NZ_ABJL02000008.1 | Bacteroides intestinalis | 642857 | 643258 |
| NZ_ABJL02000008.1 | Bacteroides intestinalis | 2029709 | 2030089 |
| NZ_ABJL02000008.1 | Bacteroides intestinalis | 1716117 | 1715746 |
| NZ_ATFI01000002.1 | Bacteroides cellulosilyticus | 74483 | 74112 |
| NZ_ATFI01000012.1 | Bacteroides cellulosilyticus | 122628 | 123029 |
| NZ_CVOY01000013.1 | Bacteroides thetaiotaomicron | 191727 | 192140 |
| NZ_CVOY01000058.1 | Bacteroides thetaiotaomicron | 28964 | 28593 |
| NZ_DS264541.1 | Parabacteroides merdae | 67177 | 66776 |
| NZ_DS362236.1 | Bacteroides uniformis | 38489 | 38878 |
| NZ_DS362245.1 | Bacteroides uniformis | 24062 | 24184 |
| NZ_DS362245.1 | Bacteroides uniformis | 24267 | 24356 |
| NZ_DS362245.1 | Bacteroides uniformis | 24193 | 24264 |
| NZ_DS480694.1 | Clostridium bolteae | 252033 | 252386 |
| NZ_DS499718.1 | Clostridium scindens | 309983 | 309654 |
| NZ_DS995528.1 | Bacteroides dorei | 127411 | 127812 |
| NZ_DS995533.1 | Bacteroides dorei | 131728 | 131327 |
| NZ_DS996447.1 | Parabacteroides johnsonii | 92123 | 91722 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS996455.1 | *Parabacteroides johnsonii* | 41510 | 41118 |
| NZ_DS996455.1 | *Parabacteroides johnsonii* | 41091 | 40711 |
| NZ_EQ973488.1 | *Bacteroides cellulosilyticus* | 155148 | 154777 |
| NZ_EQ973492.1 | *Bacteroides cellulosilyticus* | 200913 | 200512 |
| NZ_GG657592.1 | *Clostridium asparagiforme* | 560671 | 561042 |
| NZ_GG667665.1 | *Hungatella hathewayi* | 3412 | 3059 |
| NZ_GG688317.1 | *Bacteroides finegoldii* | 373129 | 372716 |
| NZ_GG688317.1 | *Bacteroides finegoldii* | 351401 | 351003 |
| NZ_JGDE01000115.1 | *Bacteroides fragilis* | 2024 | 1617 |
| NZ_JH370371.1 | *Alistipes indistinctus* | 1113682 | 1114062 |
| NZ_JH724297.1 | *Bacteroides xylanisolvens* | 171556 | 171143 |
| NZ_JH724297.1 | *Bacteroides xylanisolvens* | 107227 | 106856 |
| NZ_PUEM01000006.1 | *Clostridium bolteae* | 5784734 | 5784381 |
| NZ_PUEO01000014.1 | *Bacteroides thetaiotaomicron* | 3563261 | 3562848 |
| NZ_PUEO01000014.1 | *Bacteroides thetaiotaomicron* | 3514703 | 3514332 |
| NZ_PUEP01000005.1 | *Bacteroides ovatus* | 528515 | 528928 |
| NZ_PUEQ01000002.1 | *Bacteroides caccae* | 463991 | 464404 |
| NZ_PUEQ01000002.1 | *Bacteroides caccae* | 521965 | 522336 |
| NZ_UFTH01000001.1 | *Bacteroides fragilis* | 100554 | 100147 |
| NZ_UFTH01000001.1 | *Bacteroides fragilis* | 3470508 | 3470128 |
| BACDOR_03091 | | 1 | 254 |
| CVOZ01000016.1 | *Bacteroides thetaiotaomicron* | 213809 | 214567 |
| JGCP01001391.1 | *Bacteroides fragilis* | 1827 | 1213 |
| JGCP01002541.1 | *Bacteroides fragilis* | 59029 | 58271 |
| NC_009614.1 | *Bacteroides vulgatus* | 2545071 | 2545832 |
| NZ_AAVM02000007.1 | *Bacteroides caccae* | 240333 | 241091 |
| NZ_ABJL02000002.1 | *Bacteroides intestinalis* | 14878 | 14120 |
| NZ_ATFI01000018.1 | *Bacteroides cellulosilyticus* | 73581 | 72838 |
| NZ_CVOY01000004.1 | *Bacteroides thetaiotaomicron* | 107627 | 108385 |
| NZ_DS264546.1 | *Parabacteroides merdae* | 161605 | 162363 |
| NZ_DS264580.1 | *Bacteroides ovatus* | 422161 | 422919 |
| NZ_DS362242.1 | *Bacteroides uniformis* | 128891 | 128124 |
| NZ_DS499676.1 | *Bacteroides stercoris* | 354507 | 353740 |
| NZ_DS995508.1 | *Bacteroides eggerthii* | 374349 | 375116 |
| NZ_DS995536.1 | *Bacteroides dorei* | 46897 | 46136 |
| NZ_DS996455.1 | *Parabacteroides johnsonii* | 310203 | 311213 |
| NZ_EQ973489.1 | *Bacteroides cellulosilyticus* | 471401 | 472159 |
| NZ_EQ973643.1 | *Bacteroides coprophilus* | 27626 | 28387 |
| NZ_GG688318.1 | *Bacteroides finegoldii* | 85948 | 85178 |
| NZ_GG688321.1 | *Bacteroides finegoldii* | 185788 | 185030 |
| NZ_JGDE01000131.1 | *Bacteroides fragilis* | 10637 | 9879 |
| NZ_JH370372.1 | *Alistipes indistinctus* | 247942 | 248700 |
| NZ_JH724296.1 | *Bacteroides xylanisolvens* | 113928 | 113170 |
| NZ_PUEO01000011.1 | *Bacteroides thetaiotaomicron* | 447878 | 448636 |
| NZ_PUEP01000015.1 | *Bacteroides ovatus* | 275761 | 276519 |
| NZ_PUEQ01000003.1 | *Bacteroides caccae* | 478198 | 478956 |
| NZ_UFTH01000001.1 | *Bacteroides fragilis* | 906258 | 905500 |
| CVOZ01000011.1 | *Bacteroides thetaiotaomicron* | 219980 | 219420 |
| CVOZ01000016.1 | *Bacteroides thetaiotaomicron* | 167582 | 167028 |
| CVOZ01000025.1 | *Bacteroides thetaiotaomicron* | 66610 | 66056 |
| CVOZ01000044.1 | *Bacteroides thetaiotaomicron* | 108057 | 107521 |
| CVOZ01000063.1 | *Bacteroides thetaiotaomicron* | 143061 | 143615 |
| CVOZ01000063.1 | *Bacteroides thetaiotaomicron* | 145810 | 146208 |
| JGCP01000973.1 | *Bacteroides fragilis* | 643 | 92 |
| JGCP01001566.1 | *Bacteroides fragilis* | 1249 | 839 |
| JGCP01002360.1 | *Bacteroides fragilis* | 23022 | 22462 |
| JGCP01002412.1 | *Bacteroides fragilis* | 4210 | 3653 |
| JGCP01002443.1 | *Bacteroides fragilis* | 42592 | 42056 |
| JGCP01002542.1 | *Bacteroides fragilis* | 18080 | 18631 |
| JGCP01002566.1 | *Bacteroides fragilis* | 42801 | 43268 |
| NC_009614.1 | *Bacteroides vulgatus* | 3183720 | 3184280 |
| NC_009614.1 | *Bacteroides vulgatus* | 499623 | 499123 |
| NC_009614.1 | *Bacteroides vulgatus* | 4349638 | 4350111 |
| NC_009614.1 | *Bacteroides vulgatus* | 4776064 | 4775543 |
| NC_009615.1 | *Parabacteroides distasonis* | 4127877 | 4128401 |
| NC_009615.1 | *Parabacteroides distasonis* | 2031801 | 2032322 |
| NC_009615.1 | *Parabacteroides distasonis* | 1603192 | 1602650 |
| NC_009615.1 | *Parabacteroides distasonis* | 682204 | 682719 |
| NC_009615.1 | *Parabacteroides distasonis* | 3533129 | 3533686 |
| NZ_AAVM02000001.1 | *Bacteroides caccae* | 189463 | 188936 |
| NZ_AAVM02000001.1 | *Bacteroides caccae* | 1211906 | 1212442 |
| NZ_AAVM02000005.1 | *Bacteroides caccae* | 151298 | 151846 |
| NZ_AAVM02000006.1 | *Bacteroides caccae* | 287613 | 287059 |
| NZ_AAVM02000010.1 | *Bacteroides caccae* | 85074 | 85634 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_ABJL02000008.1 | Bacteroides intestinalis | 2132288 | 2132833 |
| NZ_ABJL02000008.1 | Bacteroides intestinalis | 2131519 | 2132073 |
| NZ_ABJL02000008.1 | Bacteroides intestinalis | 679330 | 679866 |
| NZ_ATFI01000005.1 | Bacteroides cellulosilyticus | 230282 | 230836 |
| NZ_ATFI01000005.1 | Bacteroides cellulosilyticus | 231097 | 231633 |
| NZ_ATFI01000007.1 | Bacteroides cellulosilyticus | 321265 | 320705 |
| NZ_ATFI01000012.1 | Bacteroides cellulosilyticus | 160096 | 160632 |
| NZ_CVOY01000001.1 | Bacteroides thetaiotaomicron | 79232 | 78672 |
| NZ_CVOY01000013.1 | Bacteroides thetaiotaomicron | 62072 | 61518 |
| NZ_CVOY01000030.1 | Bacteroides thetaiotaomicron | 4322 | 3768 |
| NZ_CVOY01000035.1 | Bacteroides thetaiotaomicron | 14717 | 14181 |
| NZ_CVOY01000058.1 | Bacteroides thetaiotaomicron | 33237 | 32683 |
| NZ_CVOY01000058.1 | Bacteroides thetaiotaomicron | 30488 | 30090 |
| NZ_DS264546.1 | Parabacteroides merdae | 78860 | 79414 |
| NZ_DS264550.1 | Parabacteroides merdae | 128183 | 127710 |
| NZ_DS264553.1 | Bacteroides ovatus | 176225 | 176785 |
| NZ_DS264580.1 | Bacteroides ovatus | 123123 | 122575 |
| NZ_DS264580.1 | Bacteroides ovatus | 354346 | 353792 |
| NZ_DS264583.1 | Bacteroides ovatus | 172043 | 172597 |
| NZ_DS362220.1 | Bacteroides uniformis | 32266 | 32826 |
| NZ_DS362220.1 | Bacteroides uniformis | 254449 | 253925 |
| NZ_DS362244.1 | Bacteroides uniformis | 102221 | 101685 |
| NZ_DS362249.1 | Bacteroides uniformis | 419154 | 418600 |
| NZ_DS362249.1 | Bacteroides uniformis | 362515 | 363072 |
| NZ_DS499662.1 | Bacteroides stercoris | 200073 | 200540 |
| NZ_DS499670.1 | Bacteroides stercoris | 42083 | 41586 |
| NZ_DS499673.1 | Bacteroides stercoris | 90740 | 91294 |
| NZ_DS499673.1 | Bacteroides stercoris | 541813 | 541277 |
| NZ_DS995510.1 | Bacteroides eggerthii | 371763 | 371206 |
| NZ_DS995510.1 | Bacteroides eggerthii | 628791 | 628255 |
| NZ_DS995511.1 | Bacteroides eggerthii | 217868 | 218320 |
| NZ_DS995528.1 | Bacteroides dorei | 122323 | 122823 |
| NZ_DS995531.1 | Bacteroides dorei | 766509 | 767030 |
| NZ_DS995537.1 | Bacteroides dorei | 622118 | 622678 |
| NZ_DS995537.1 | Bacteroides dorei | 760012 | 760485 |
| NZ_DS996445.1 | Parabacteroides johnsonii | 218590 | 219132 |
| NZ_DS996453.1 | Parabacteroides johnsonii | 227358 | 227912 |
| NZ_EQ973491.1 | Bacteroides cellulosilyticus | 1248851 | 1248297 |
| NZ_EQ973491.1 | Bacteroides cellulosilyticus | 1248036 | 1247500 |
| NZ_EQ973492.1 | Bacteroides cellulosilyticus | 842623 | 842063 |
| NZ_EQ973492.1 | Bacteroides cellulosilyticus | 135050 | 134514 |
| NZ_EQ973635.1 | Bacteroides coprophilus | 258217 | 257702 |
| NZ_EQ973643.1 | Bacteroides coprophilus | 609437 | 609997 |
| NZ_EQ973643.1 | Bacteroides coprophilus | 520140 | 520700 |
| NZ_GG688324.1 | Bacteroides finegoldii | 201991 | 201455 |
| NZ_GG688326.1 | Bacteroides finegoldii | 160158 | 160718 |
| NZ_GG703852.1 | Prevotella copri | 780182 | 779757 |
| NZ_JGDE01000045.1 | Bacteroides fragilis | 38908 | 38351 |
| NZ_JGDE01000073.1 | Bacteroides fragilis | 41461 | 40925 |
| NZ_JGDE01000133.1 | Bacteroides fragilis | 26430 | 26981 |
| NZ_JGDE01000148.1 | Bacteroides fragilis | 50583 | 51050 |
| NZ_JH724294.1 | Bacteroides xylanisolvens | 2266949 | 2266389 |
| NZ_JH724294.1 | Bacteroides xylanisolvens | 1638830 | 1638294 |
| NZ_JH724296.1 | Bacteroides xylanisolvens | 516372 | 516920 |
| NZ_JH724296.1 | Bacteroides xylanisolvens | 205601 | 206155 |
| NZ_JH724297.1 | Bacteroides xylanisolvens | 108883 | 108359 |
| NZ_PUEO01000011.1 | Bacteroides thetaiotaomicron | 85768 | 85208 |
| NZ_PUEO01000011.1 | Bacteroides thetaiotaomicron | 401651 | 401097 |
| NZ_PUEO01000014.1 | Bacteroides thetaiotaomicron | 3707772 | 3708326 |
| NZ_PUEO01000014.1 | Bacteroides thetaiotaomicron | 3518976 | 3518422 |
| NZ_PUEO01000014.1 | Bacteroides thetaiotaomicron | 3337890 | 3338426 |
| NZ_PUEO01000014.1 | Bacteroides thetaiotaomicron | 3516227 | 3515829 |
| NZ_PUEP01000005.1 | Bacteroides ovatus | 1141525 | 1142085 |
| NZ_PUEP01000005.1 | Bacteroides ovatus | 332723 | 332169 |
| NZ_PUEP01000005.1 | Bacteroides ovatus | 5888755 | 5888207 |
| NZ_PUEP01000005.1 | Bacteroides ovatus | 1851269 | 1851805 |
| NZ_PUEP01000015.1 | Bacteroides ovatus | 207946 | 207392 |
| NZ_PUEQ01000002.1 | Bacteroides caccae | 334672 | 334118 |
| NZ_PUEQ01000002.1 | Bacteroides caccae | 518182 | 518730 |
| NZ_PUEQ01000003.1 | Bacteroides caccae | 2119824 | 2119264 |
| NZ_PUEQ01000003.1 | Bacteroides caccae | 3811487 | 3810960 |
| NZ_PUEQ01000003.1 | Bacteroides caccae | 1500715 | 1501251 |
| NZ_UFTH01000001.1 | Bacteroides fragilis | 2312130 | 2311570 |
| NZ_UFTH01000001.1 | Bacteroides fragilis | 1453837 | 1454397 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_UFTH01000001.1 | Bacteroides fragilis | 986751 | 987302 |
| NZ_UFTH01000001.1 | Bacteroides fragilis | 3476837 | 3476280 |
| NZ_UFTH01000001.1 | Bacteroides fragilis | 4140659 | 4140123 |
| NZ_UFTH01000001.1 | Bacteroides fragilis | 619273 | 618815 |
| BACDOR_03934 | | 1 | 383 |
| CVOZ01000011.1 | Bacteroides thetaiotaomicron | 219307 | 218162 |
| CVOZ01000025.1 | Bacteroides thetaiotaomicron | 65950 | 64922 |
| JGCP01000352.1 | Bacteroides fragilis | 1001 | 3 |
| JGCP01002360.1 | Bacteroides fragilis | 22362 | 21214 |
| NC_009614.1 | Bacteroides vulgatus | 3184401 | 3185549 |
| NC_009615.1 | Parabacteroides distasonis | 4010282 | 4011415 |
| NC_010655.1 | Akkermansia muciniphila | 2181548 | 2180451 |
| NC_010655.1 | Akkermansia muciniphila | 910779 | 911906 |
| NZ_AAVM02000006.1 | Bacteroides caccae | 286955 | 285927 |
| NZ_AAVM02000010.1 | Bacteroides caccae | 85750 | 86895 |
| NZ_ABJL02000007.1 | Bacteroides intestinalis | 1352596 | 1353708 |
| NZ_ABJL02000008.1 | Bacteroides intestinalis | 11440 | 12579 |
| NZ_ATFI01000007.1 | Bacteroides cellulosilyticus | 320605 | 319457 |
| NZ_ATFI01000007.1 | Bacteroides cellulosilyticus | 433197 | 432070 |
| NZ_ATFI01000007.1 | Bacteroides cellulosilyticus | 180818 | 179655 |
| NZ_CVOY01000001.1 | Bacteroides thetaiotaomicron | 78559 | 77414 |
| NZ_CVOY01000013.1 | Bacteroides thetaiotaomicron | 61412 | 60384 |
| NZ_DS264546.1 | Parabacteroides merdae | 79514 | 80632 |
| NZ_DS264553.1 | Bacteroides ovatus | 176886 | 178034 |
| NZ_DS264583.1 | Bacteroides ovatus | 172705 | 173733 |
| NZ_DS362220.1 | Bacteroides uniformis | 32930 | 34078 |
| NZ_DS362243.1 | Bacteroides uniformis | 130985 | 132106 |
| NZ_DS499676.1 | Bacteroides stercoris | 625044 | 623935 |
| NZ_DS499676.1 | Bacteroides stercoris | 38390 | 37269 |
| NZ_DS995510.1 | Bacteroides eggerthii | 1115618 | 1114497 |
| NZ_DS995537.1 | Bacteroides dorei | 622799 | 623947 |
| NZ_DS995538.1 | Bacteroides dorei | 80104 | 79073 |
| NZ_DS996453.1 | Parabacteroides johnsonii | 228018 | 229163 |
| NZ_DS996453.1 | Parabacteroides johnsonii | 441885 | 442970 |
| NZ_EQ973492.1 | Bacteroides cellulosilyticus | 841963 | 840815 |
| NZ_EQ973492.1 | Bacteroides cellulosilyticus | 701350 | 700187 |
| NZ_EQ973543.1 | Bacteroides cellulosilyticus | 698 | 3 |
| NZ_EQ973643.1 | Bacteroides coprophilus | 523657 | 524796 |
| NZ_GG688326.1 | Bacteroides finegoldii | 160819 | 161967 |
| NZ_JH370372.1 | Alistipes indistinctus | 793551 | 792436 |
| NZ_JH724294.1 | Bacteroides xylanisolvens | 2266288 | 2265140 |
| NZ_PUEO01000011.1 | Bacteroides thetaiotaomicron | 85095 | 83950 |
| NZ_PUEO01000014.1 | Bacteroides thetaiotaomicron | 3708432 | 3709460 |
| NZ_PUEP01000005.1 | Bacteroides ovatus | 1142186 | 1143334 |
| NZ_PUEP01000005.1 | Bacteroides ovatus | 332061 | 331033 |
| NZ_PUEQ01000002.1 | Bacteroides caccae | 334014 | 332986 |
| NZ_PUEQ01000003.1 | Bacteroides caccae | 2119148 | 2118003 |
| NZ_UFTH01000001.1 | Bacteroides fragilis | 2311470 | 2310322 |
| BACDOR_03379 | | 1 | 283 |
| BT_4075 | | 177 | 231 |
| BT_4096 | | 6 | 227 |
| COLAER_00815 | | 98 | 240 |
| CVOZ01000004.1 | Bacteroides thetaiotaomicron | 1448 | 2302 |
| CVOZ01000011.1 | Bacteroides thetaiotaomicron | 76210 | 77025 |
| JGCP01002268.1 | Bacteroides fragilis | 1309 | 668 |
| NC_009614.1 | Bacteroides vulgatus | 2618474 | 2619322 |
| NZ_AAVM02000002.1 | Bacteroides caccae | 22009 | 21158 |
| NZ_CVOY01000037.1 | Bacteroides thetaiotaomicron | 89304 | 90158 |
| NZ_DS264554.1 | Bacteroides ovatus | 556147 | 555293 |
| NZ_DS995537.1 | Bacteroides dorei | 24054 | 24902 |
| NZ_DS996456.1 | Parabacteroides johnsonii | 449191 | 448439 |
| NZ_JH724295.1 | Bacteroides xylanisolvens | 331849 | 330995 |
| NZ_JH724300.1 | Bacteroides xylanisolvens | 14748 | 13909 |
| NZ_PUEO01000004.1 | Bacteroides thetaiotaomicron | 699564 | 698710 |
| NZ_PUEP01000005.1 | Bacteroides ovatus | 5040181 | 5041035 |
| NZ_PUEQ01000003.1 | Bacteroides caccae | 3599902 | 3600753 |
| BT_1192 | | 73 | 143 |
| CVOZ01000002.1 | Bacteroides thetaiotaomicron | 8661 | 7258 |
| JGCP01000335.1 | Bacteroides fragilis | 8259 | 9164 |
| JGCP01001024.1 | Bacteroides fragilis | 1280 | 3 |
| JGCP01001257.1 | Bacteroides fragilis | 120 | 1442 |
| JGCP01002379.1 | Bacteroides fragilis | 49119 | 48214 |
| NC_009614.1 | Bacteroides vulgatus | 2668633 | 2669520 |
| NC_009615.1 | Parabacteroides distasonis | 249678 | 250460 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_AAVM02000002.1 | Bacteroides caccae | 123305 | 124627 |
| NZ_ABJL02000008.1 | Bacteroides intestinalis | 1704766 | 1706073 |
| NZ_ABJL02000008.1 | Bacteroides intestinalis | 2748789 | 2747893 |
| NZ_ACCL02000002.1 | Marvinbryantia formatexigens | 191124 | 192041 |
| NZ_ATFI01000004.1 | Bacteroides cellulosilyticus | 85812 | 84916 |
| NZ_CVOY01000050.1 | Bacteroides thetaiotaomicron | 36384 | 35062 |
| NZ_DS264579.1 | Bacteroides ovatus | 280554 | 281876 |
| NZ_DS362220.1 | Bacteroides uniformis | 135151 | 134237 |
| NZ_DS499676.1 | Bacteroides stercoris | 263901 | 264647 |
| NZ_DS995508.1 | Bacteroides eggerthii | 458353 | 457493 |
| NZ_DS995537.1 | Bacteroides dorei | 83077 | 83964 |
| NZ_DS996455.1 | Parabacteroides johnsonii | 32570 | 31281 |
| NZ_DS996841.1 | Holdemanella biformis | 28041 | 27679 |
| NZ_EQ973491.1 | Bacteroides cellulosilyticus | 494795 | 495691 |
| NZ_EQ973651.1 | Bacteroides coprophilus | 164919 | 166163 |
| NZ_GG657587.1 | Clostridium asparagiforme | 221025 | 221390 |
| NZ_GG692736.1 | Roseburia intestinalis | 18048 | 17698 |
| NZ_JGDE01000029.1 | Bacteroides fragilis | 59138 | 58233 |
| NZ_JH370371.1 | Alistipes indistinctus | 1369167 | 1369943 |
| NZ_JH370371.1 | Alistipes indistinctus | 1341685 | 1342116 |
| NZ_JH724295.1 | Bacteroides xylanisolvens | 574839 | 576158 |
| NZ_JH724295.1 | Bacteroides xylanisolvens | 582861 | 584183 |
| NZ_PUEO01000004.1 | Bacteroides thetaiotaomicron | 928679 | 930082 |
| NZ_PUEP01000005.1 | Bacteroides ovatus | 4741344 | 4740022 |
| NZ_PUEQ01000003.1 | Bacteroides caccae | 3498606 | 3497284 |
| NZ_UFTH01000001.1 | Bacteroides fragilis | 2926029 | 2925124 |
| BACDOR_03642 | | 180 | 274 |
| BT_4091 | | 419 | 654 |
| BT_4091 | | 5 | 222 |
| CVOZ01000011.1 | Bacteroides thetaiotaomicron | 74671 | 76059 |
| CVOZ01000011.1 | Bacteroides thetaiotaomicron | 33113 | 34528 |
| CVOZ01000021.1 | Bacteroides thetaiotaomicron | 107438 | 108184 |
| CVOZ01000021.1 | Bacteroides thetaiotaomicron | 106535 | 107161 |
| CVOZ01000033.1 | Bacteroides thetaiotaomicron | 69509 | 68802 |
| CVOZ01000033.1 | Bacteroides thetaiotaomicron | 70706 | 70098 |
| CVOZ01000041.1 | Bacteroides thetaiotaomicron | 304006 | 305376 |
| CVOZ01000043.1 | Bacteroides thetaiotaomicron | 114574 | 116010 |
| CVOZ01000043.1 | Bacteroides thetaiotaomicron | 64290 | 65657 |
| CVOZ01000043.1 | Bacteroides thetaiotaomicron | 101489 | 102028 |
| CVOZ01000043.1 | Bacteroides thetaiotaomicron | 102635 | 103321 |
| CVOZ01000044.1 | Bacteroides thetaiotaomicron | 30432 | 31790 |
| CVOZ01000044.1 | Bacteroides thetaiotaomicron | 11573 | 12922 |
| CVOZ01000044.1 | Bacteroides thetaiotaomicron | 54744 | 56120 |
| CVOZ01000045.1 | Bacteroides thetaiotaomicron | 113209 | 114579 |
| JGCP01000263.1 | Bacteroides fragilis | 828 | 1 |
| JGCP01000476.1 | Bacteroides fragilis | 1146 | 52 |
| JGCP01001016.1 | Bacteroides fragilis | 5 | 166 |
| JGCP01001396.1 | Bacteroides fragilis | 664 | 2091 |
| JGCP01001637.1 | Bacteroides fragilis | 489 | 19 |
| JGCP01001863.1 | Bacteroides fragilis | 2422 | 1022 |
| JGCP01002441.1 | Bacteroides fragilis | 11079 | 12482 |
| JGCP01002533.1 | Bacteroides fragilis | 3492 | 4082 |
| JGCP01002533.1 | Bacteroides fragilis | 4677 | 5375 |
| NC_008618.1 | Bifidobacterium adolescentis | 113104 | 114804 |
| NC_008618.1 | Bifidobacterium adolescentis | 1901066 | 1902565 |
| NC_008618.1 | Bifidobacterium adolescentis | 539816 | 540412 |
| NC_008618.1 | Bifidobacterium adolescentis | 541031 | 541483 |
| NC_009614.1 | Bacteroides vulgatus | 3437190 | 3438560 |
| NC_009614.1 | Bacteroides vulgatus | 5099014 | 5097611 |
| NC_009614.1 | Bacteroides vulgatus | 1019138 | 1018545 |
| NC_009614.1 | Bacteroides vulgatus | 1017941 | 1017240 |
| NC_009614.1 | Bacteroides vulgatus | 4737637 | 4738329 |
| NC_009614.1 | Bacteroides vulgatus | 4736464 | 4737261 |
| NC_009614.1 | Bacteroides vulgatus | 34966 | 34268 |
| NC_009614.1 | Bacteroides vulgatus | 36130 | 35552 |
| NC_009615.1 | Parabacteroides distasonis | 58665 | 57307 |
| NC_009615.1 | Parabacteroides distasonis | 3530017 | 3531420 |
| NC_010655.1 | Akkermansia muciniphila | 541896 | 543332 |
| NZ_AAVM02000001.1 | Bacteroides caccae | 1239561 | 1238158 |
| NZ_AAVM02000005.1 | Bacteroides caccae | 56513 | 57871 |
| NZ_ABJL02000002.1 | Bacteroides intestinalis | 240119 | 238749 |
| NZ_ABJL02000006.1 | Bacteroides intestinalis | 172382 | 172182 |
| NZ_ABJL02000007.1 | Bacteroides intestinalis | 719924 | 721378 |
| NZ_ABJL02000007.1 | Bacteroides intestinalis | 507938 | 508528 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_ABJL02000007.1 | Bacteroides intestinalis | 509108 | 509818 |
| NZ_ABJL02000008.1 | Bacteroides intestinalis | 3173906 | 3175297 |
| NZ_ABJL02000008.1 | Bacteroides intestinalis | 3169283 | 3167952 |
| NZ_ABJL02000008.1 | Bacteroides intestinalis | 944085 | 945464 |
| NZ_ABJL02000008.1 | Bacteroides intestinalis | 2525240 | 2524545 |
| NZ_ABJL02000008.1 | Bacteroides intestinalis | 2526407 | 2525829 |
| NZ_ABJL02000008.1 | Bacteroides intestinalis | 2484193 | 2484876 |
| NZ_ABJL02000008.1 | Bacteroides intestinalis | 2485399 | 2485773 |
| NZ_ACCL02000028.1 | Marvinbryantia formatexigens | 17836 | 18624 |
| NZ_ATFI01000001.1 | Bacteroides cellulosilyticus | 1754879 | 1755607 |
| NZ_ATFI01000001.1 | Bacteroides cellulosilyticus | 716683 | 715988 |
| NZ_ATFI01000001.1 | Bacteroides cellulosilyticus | 717868 | 717170 |
| NZ_ATFI01000001.1 | Bacteroides cellulosilyticus | 340148 | 339480 |
| NZ_DS995537.1 | Bacteroides dorei | 622799 | 623947 |
| NZ_DS995538.1 | Bacteroides dorei | 80104 | 79073 |
| NZ_DS996453.1 | Parabacteroides johnsonii | 228018 | 229163 |
| NZ_DS996453.1 | Parabacteroides johnsonii | 441885 | 442970 |
| NZ_EQ973492.1 | Bacteroides cellulosilyticus | 841963 | 840815 |
| NZ_EQ973492.1 | Bacteroides cellulosilyticus | 701350 | 700187 |
| NZ_EQ973543.1 | Bacteroides cellulosilyticus | 698 | 3 |
| NZ_EQ973643.1 | Bacteroides coprophilus | 523657 | 524796 |
| NZ_GG688326.1 | Bacteroides finegoldii | 160819 | 161967 |
| NZ_JH370372.1 | Alistipes indistinctus | 793551 | 792436 |
| NZ_JH724294.1 | Bacteroides xylanisolvens | 2266288 | 2265140 |
| NZ_PUEO01000011.1 | Bacteroides thetaiotaomicron | 85095 | 83950 |
| NZ_PUEO01000014.1 | Bacteroides thetaiotaomicron | 3708432 | 3709460 |
| NZ_PUEP01000005.1 | Bacteroides ovatus | 1142186 | 1143334 |
| NZ_PUEP01000005.1 | Bacteroides ovatus | 332061 | 331033 |
| NZ_PUEQ01000002.1 | Bacteroides caccae | 334014 | 332986 |
| NZ_PUEQ01000003.1 | Bacteroides caccae | 2119148 | 2118003 |
| NZ_UFTH01000001.1 | Bacteroides fragilis | 2311470 | 2310322 |
| BACDOR_03379 |  | 1 | 283 |
| BT_4075 |  | 177 | 231 |
| BT_4096 |  | 6 | 227 |
| COLAER_00815 |  | 98 | 240 |
| CVOZ01000004.1 | Bacteroides thetaiotaomicron | 1448 | 2302 |
| CVOZ01000011.1 | Bacteroides thetaiotaomicron | 76210 | 77025 |
| JGCP01002268.1 | Bacteroides fragilis | 1309 | 668 |
| NC_009614.1 | Bacteroides vulgatus | 2618474 | 2619322 |
| NZ_AAVM02000002.1 | Bacteroides caccae | 22009 | 21158 |
| NZ_CVOY01000037.1 | Bacteroides thetaiotaomicron | 89304 | 90158 |
| NZ_DS264554.1 | Bacteroides ovatus | 556147 | 555293 |
| NZ_DS995537.1 | Bacteroides dorei | 24054 | 24902 |
| NZ_DS996456.1 | Parabacteroides johnsonii | 449191 | 448439 |
| NZ_JH724295.1 | Bacteroides xylanisolvens | 331849 | 330995 |
| NZ_JH724300.1 | Bacteroides xylanisolvens | 14748 | 13909 |
| NZ_PUEO01000004.1 | Bacteroides thetaiotaomicron | 699564 | 698710 |
| NZ_PUEP01000005.1 | Bacteroides ovatus | 5040181 | 5041035 |
| NZ_PUEQ01000003.1 | Bacteroides caccae | 3599902 | 3600753 |
| BT_1192 |  | 73 | 143 |
| CVOZ01000002.1 | Bacteroides thetaiotaomicron | 8661 | 7258 |
| JGCP01000335.1 | Bacteroides fragilis | 8259 | 9164 |
| JGCP01001024.1 | Bacteroides fragilis | 1280 | 3 |
| JGCP01001257.1 | Bacteroides fragilis | 120 | 1442 |
| JGCP01002379.1 | Bacteroides fragilis | 49119 | 48214 |
| NC_009614.1 | Bacteroides vulgatus | 2668633 | 2669520 |
| NC_009615.1 | Parabacteroides distasonis | 249678 | 250460 |
| NZ_AAVM02000002.1 | Bacteroides caccae | 123305 | 124627 |
| NZ_ABJL02000008.1 | Bacteroides intestinalis | 1704766 | 1706073 |
| NZ_ABJL02000008.1 | Bacteroides intestinalis | 2748789 | 2747893 |
| NZ_ACCL02000002.1 | Marvinbryantia formatexigens | 191124 | 192041 |
| NZ_ATFI01000004.1 | Bacteroides cellulosilyticus | 85812 | 84916 |
| NZ_CVOY01000050.1 | Bacteroides thetaiotaomicron | 36384 | 35062 |
| NZ_DS264579.1 | Bacteroides ovatus | 280554 | 281876 |
| NZ_DS362220.1 | Bacteroides uniformis | 135151 | 134237 |
| NZ_DS499676.1 | Bacteroides stercoris | 263901 | 264647 |
| NZ_DS995508.1 | Bacteroides eggerthii | 458353 | 457493 |
| NZ_DS995537.1 | Bacteroides dorei | 83077 | 83964 |
| NZ_DS996455.1 | Parabacteroides johnsonii | 32570 | 31281 |
| NZ_DS996841.1 | Holdemanella biformis | 28041 | 27679 |
| NZ_EQ973491.1 | Bacteroides cellulosilyticus | 494795 | 495691 |
| NZ_EQ973651.1 | Bacteroides coprophilus | 164919 | 166163 |
| NZ_GG657587.1 | Clostridium asparagiforme | 221025 | 221390 |
| NZ_GG692736.1 | Roseburia intestinalis | 18048 | 17698 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_JGDE01000029.1 | *Bacteroides fragilis* | 59138 | 58233 |
| NZ_JH370371.1 | *Alistipes indistinctus* | 1369167 | 1369943 |
| NZ_JH370371.1 | *Alistipes indistinctus* | 1341685 | 1342116 |
| NZ_JH724295.1 | *Bacteroides xylanisolvens* | 574839 | 576158 |
| NZ_JH724295.1 | *Bacteroides xylanisolvens* | 582861 | 584183 |
| NZ_PUEO01000004.1 | *Bacteroides thetaiotaomicron* | 928679 | 930082 |
| NZ_PUEP01000005.1 | *Bacteroides ovatus* | 4741344 | 4740022 |
| NZ_PUEQ01000003.1 | *Bacteroides caccae* | 3498606 | 3497284 |
| NZ_UFTH01000001.1 | *Bacteroides fragilis* | 2926029 | 2925124 |
| BACDOR_03642 | | 180 | 274 |
| BT_4091 | | 419 | 654 |
| BT_4091 | | 5 | 222 |
| CVOZ01000011.1 | *Bacteroides thetaiotaomicron* | 74671 | 76059 |
| CVOZ01000011.1 | *Bacteroides thetaiotaomicron* | 33113 | 34528 |
| CVOZ01000021.1 | *Bacteroides thetaiotaomicron* | 107438 | 108184 |
| CVOZ01000021.1 | *Bacteroides thetaiotaomicron* | 106535 | 107161 |
| CVOZ01000033.1 | *Bacteroides thetaiotaomicron* | 69509 | 68802 |
| CVOZ01000033.1 | *Bacteroides thetaiotaomicron* | 70706 | 70098 |
| CVOZ01000041.1 | *Bacteroides thetaiotaomicron* | 304006 | 305376 |
| CVOZ01000043.1 | *Bacteroides thetaiotaomicron* | 114574 | 116010 |
| CVOZ01000043.1 | *Bacteroides thetaiotaomicron* | 64290 | 65657 |
| CVOZ01000043.1 | *Bacteroides thetaiotaomicron* | 101489 | 102028 |
| CVOZ01000043.1 | *Bacteroides thetaiotaomicron* | 102635 | 103321 |
| CVOZ01000044.1 | *Bacteroides thetaiotaomicron* | 30432 | 31790 |
| CVOZ01000044.1 | *Bacteroides thetaiotaomicron* | 11573 | 12922 |
| CVOZ01000044.1 | *Bacteroides thetaiotaomicron* | 54744 | 56120 |
| CVOZ01000045.1 | *Bacteroides thetaiotaomicron* | 113209 | 114579 |
| JGCP01000263.1 | *Bacteroides fragilis* | 828 | 1 |
| JGCP01000476.1 | *Bacteroides fragilis* | 1146 | 52 |
| JGCP01001016.1 | *Bacteroides fragilis* | 5 | 166 |
| JGCP01001396.1 | *Bacteroides fragilis* | 664 | 2091 |
| JGCP01001637.1 | *Bacteroides fragilis* | 489 | 19 |
| JGCP01001863.1 | *Bacteroides fragilis* | 2422 | 1022 |
| JGCP01002441.1 | *Bacteroides fragilis* | 11079 | 12482 |
| JGCP01002533.1 | *Bacteroides fragilis* | 3492 | 4082 |
| JGCP01002533.1 | *Bacteroides fragilis* | 4677 | 5375 |
| NC_008618.1 | *Bifidobacterium adolescentis* | 113104 | 114804 |
| NC_008618.1 | *Bifidobacterium adolescentis* | 1901066 | 1902565 |
| NC_008618.1 | *Bifidobacterium adolescentis* | 539816 | 540412 |
| NC_008618.1 | *Bifidobacterium adolescentis* | 541031 | 541483 |
| NC_009614.1 | *Bacteroides vulgatus* | 3437190 | 3438560 |
| NC_009614.1 | *Bacteroides vulgatus* | 5099014 | 5097611 |
| NC_009614.1 | *Bacteroides vulgatus* | 1019138 | 1018545 |
| NC_009614.1 | *Bacteroides vulgatus* | 1017941 | 1017240 |
| NC_009614.1 | *Bacteroides vulgatus* | 4737637 | 4738329 |
| NC_009614.1 | *Bacteroides vulgatus* | 4736464 | 4737261 |
| NC_009614.1 | *Bacteroides vulgatus* | 34966 | 34268 |
| NC_009614.1 | *Bacteroides vulgatus* | 36130 | 35552 |
| NC_009615.1 | *Parabacteroides distasonis* | 58665 | 57307 |
| NC_009615.1 | *Parabacteroides distasonis* | 3530017 | 3531420 |
| NC_010655.1 | *Akkermansia muciniphila* | 541896 | 543332 |
| NZ_AAVM02000001.1 | *Bacteroides caccae* | 1239561 | 1238158 |
| NZ_AAVM02000005.1 | *Bacteroides caccae* | 56513 | 57871 |
| NZ_ABJL02000002.1 | *Bacteroides intestinalis* | 240119 | 238749 |
| NZ_ABJL02000006.1 | *Bacteroides intestinalis* | 172382 | 172182 |
| NZ_ABJL02000007.1 | *Bacteroides intestinalis* | 719924 | 721378 |
| NZ_ABJL02000007.1 | *Bacteroides intestinalis* | 507938 | 508528 |
| NZ_ABJL02000007.1 | *Bacteroides intestinalis* | 509108 | 509818 |
| NZ_ABJL02000008.1 | *Bacteroides intestinalis* | 3173906 | 3175297 |
| NZ_ABJL02000008.1 | *Bacteroides intestinalis* | 3169283 | 3167952 |
| NZ_ABJL02000008.1 | *Bacteroides intestinalis* | 944085 | 945464 |
| NZ_ABJL02000008.1 | *Bacteroides intestinalis* | 2525240 | 2524545 |
| NZ_ABJL02000008.1 | *Bacteroides intestinalis* | 2526407 | 2525829 |
| NZ_ABJL02000008.1 | *Bacteroides intestinalis* | 2484193 | 2484876 |
| NZ_ABJL02000008.1 | *Bacteroides intestinalis* | 2485399 | 2485773 |
| NZ_ACCL02000028.1 | *Marvinbryantia formatexigens* | 17836 | 18624 |
| NZ_ATFI01000001.1 | *Bacteroides cellulosilyticus* | 1754879 | 1755607 |
| NZ_ATFI01000001.1 | *Bacteroides cellulosilyticus* | 716683 | 715988 |
| NZ_ATFI01000001.1 | *Bacteroides cellulosilyticus* | 717868 | 717170 |
| NZ_ATFI01000001.1 | *Bacteroides cellulosilyticus* | 340148 | 339480 |
| NZ_ATFI01000001.1 | *Bacteroides cellulosilyticus* | 1753760 | 1754329 |
| NZ_ATFI01000001.1 | *Bacteroides cellulosilyticus* | 341297 | 340749 |
| NZ_ATFI01000004.1 | *Bacteroides cellulosilyticus* | 667727 | 669118 |
| NZ_ATFI01000004.1 | *Bacteroides cellulosilyticus* | 665971 | 664640 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_ATFI01000004.1 | Bacteroides cellulosilyticus | 634679 | 636016 |
| NZ_ATFI01000004.1 | Bacteroides cellulosilyticus | 636101 | 637438 |
| NZ_ATFI01000004.1 | Bacteroides cellulosilyticus | 748203 | 746851 |
| NZ_ATFI01000009.1 | Bacteroides cellulosilyticus | 344620 | 343925 |
| NZ_ATFI01000009.1 | Bacteroides cellulosilyticus | 345787 | 345209 |
| NZ_ATFI01000009.1 | Bacteroides cellulosilyticus | 291205 | 291885 |
| NZ_ATFI01000009.1 | Bacteroides cellulosilyticus | 292408 | 292782 |
| NZ_ATFI01000010.1 | Bacteroides cellulosilyticus | 116498 | 115128 |
| NZ_ATFI01000013.1 | Bacteroides cellulosilyticus | 166257 | 164884 |
| NZ_CVOY01000004.1 | Bacteroides thetaiotaomicron | 2896 | 3603 |
| NZ_CVOY01000004.1 | Bacteroides thetaiotaomicron | 1699 | 2307 |
| NZ_CVOY01000015.1 | Bacteroides thetaiotaomicron | 29835 | 31205 |
| NZ_CVOY01000028.1 | Bacteroides thetaiotaomicron | 92641 | 94011 |
| NZ_CVOY01000029.1 | Bacteroides thetaiotaomicron | 122519 | 123865 |
| NZ_CVOY01000041.1 | Bacteroides thetaiotaomicron | 66500 | 65124 |
| NZ_CVOY01000043.1 | Bacteroides thetaiotaomicron | 51552 | 52919 |
| NZ_CVOY01000050.1 | Bacteroides thetaiotaomicron | 19916 | 21352 |
| NZ_CVOY01000050.1 | Bacteroides thetaiotaomicron | 6767 | 7363 |
| NZ_CVOY01000050.1 | Bacteroides thetaiotaomicron | 7970 | 8656 |
| NZ_CVOY01000089.1 | Bacteroides thetaiotaomicron | 11279 | 12025 |
| NZ_CVOY01000089.1 | Bacteroides thetaiotaomicron | 10376 | 11002 |
| NZ_CVOY01000094.1 | Bacteroides thetaiotaomicron | 1 | 846 |
| NZ_CVOY01000102.1 | Bacteroides thetaiotaomicron | 4048 | 2699 |
| NZ_CVOY01000120.1 | Bacteroides thetaiotaomicron | 2031 | 2558 |
| NZ_DS264461.1 | Parabacteroides merdae | 326679 | 328088 |
| NZ_DS264553.1 | Bacteroides ovatus | 485184 | 483814 |
| NZ_DS264563.1 | Bacteroides ovatus | 240601 | 239249 |
| NZ_DS264563.1 | Bacteroides ovatus | 230088 | 231446 |
| NZ_DS264579.1 | Bacteroides ovatus | 190274 | 188934 |
| NZ_DS264579.1 | Bacteroides ovatus | 345939 | 344572 |
| NZ_DS264579.1 | Bacteroides ovatus | 26411 | 27115 |
| NZ_DS264579.1 | Bacteroides ovatus | 25214 | 25867 |
| NZ_DS264581.1 | Bacteroides ovatus | 193952 | 193377 |
| NZ_DS264581.1 | Bacteroides ovatus | 192791 | 192096 |
| NZ_DS264583.1 | Bacteroides ovatus | 293997 | 293422 |
| NZ_DS264583.1 | Bacteroides ovatus | 292812 | 292450 |
| NZ_DS264584.1 | Bacteroides ovatus | 458625 | 459983 |
| NZ_DS362248.1 | Bacteroides uniformis | 463612 | 462248 |
| NZ_DS362248.1 | Bacteroides uniformis | 44198 | 45535 |
| NZ_DS499654.1 | Erysipelatoclostridium ramosum | 458831 | 460294 |
| NZ_DS499669.1 | Bacteroides stercoris | 56028 | 54667 |
| NZ_DS499673.1 | Bacteroides stercoris | 494276 | 495676 |
| NZ_DS995509.1 | Bacteroides eggerthii | 43221 | 44582 |
| NZ_DS995509.1 | Bacteroides eggerthii | 775569 | 776297 |
| NZ_DS995509.1 | Bacteroides eggerthii | 772156 | 771578 |
| NZ_DS995509.1 | Bacteroides eggerthii | 774495 | 775103 |
| NZ_DS995509.1 | Bacteroides eggerthii | 770989 | 770606 |
| NZ_DS995510.1 | Bacteroides eggerthii | 502400 | 501018 |
| NZ_DS995510.1 | Bacteroides eggerthii | 528488 | 529825 |
| NZ_DS995510.1 | Bacteroides eggerthii | 204435 | 205853 |
| NZ_DS995511.1 | Bacteroides eggerthii | 320527 | 319190 |
| NZ_DS995511.1 | Bacteroides eggerthii | 378660 | 377212 |
| NZ_DS995511.1 | Bacteroides eggerthii | 445669 | 444224 |
| NZ_DS995531.1 | Bacteroides dorei | 371558 | 372925 |
| NZ_DS995531.1 | Bacteroides dorei | 449132 | 450535 |
| NZ_DS995531.1 | Bacteroides dorei | 312254 | 312832 |
| NZ_DS995531.1 | Bacteroides dorei | 313421 | 314116 |
| NZ_DS995533.1 | Bacteroides dorei | 1775 | 1083 |
| NZ_DS995533.1 | Bacteroides dorei | 2948 | 2379 |
| NZ_DS995537.1 | Bacteroides dorei | 920220 | 921590 |
| NZ_DS995538.1 | Bacteroides dorei | 45726 | 45025 |
| NZ_DS995538.1 | Bacteroides dorei | 46932 | 46330 |
| NZ_DS996444.1 | Parabacteroides johnsonii | 535363 | 536772 |
| NZ_DS996444.1 | Parabacteroides johnsonii | 269736 | 269134 |
| NZ_DS996444.1 | Parabacteroides johnsonii | 268632 | 268198 |
| NZ_EQ973486.1 | Bacteroides cellulosilyticus | 124072 | 122681 |
| NZ_EQ973486.1 | Bacteroides cellulosilyticus | 126082 | 127413 |
| NZ_EQ973486.1 | Bacteroides cellulosilyticus | 157708 | 156371 |
| NZ_EQ973486.1 | Bacteroides cellulosilyticus | 156286 | 154949 |
| NZ_EQ973486.1 | Bacteroides cellulosilyticus | 42916 | 44025 |
| NZ_EQ973486.1 | Bacteroides cellulosilyticus | 43994 | 44269 |
| NZ_EQ973490.1 | Bacteroides cellulosilyticus | 50726 | 49353 |
| NZ_EQ973490.1 | Bacteroides cellulosilyticus | 1964751 | 1965479 |
| NZ_EQ973490.1 | Bacteroides cellulosilyticus | 811729 | 811031 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_EQ973490.1 | *Bacteroides cellulosilyticus* | 445831 | 445163 |
| NZ_EQ973490.1 | *Bacteroides cellulosilyticus* | 810544 | 810017 |
| NZ_EQ973490.1 | *Bacteroides cellulosilyticus* | 1963632 | 1964201 |
| NZ_EQ973490.1 | *Bacteroides cellulosilyticus* | 446980 | 446432 |
| NZ_EQ973491.1 | *Bacteroides cellulosilyticus* | 107522 | 108793 |
| NZ_EQ973491.1 | *Bacteroides cellulosilyticus* | 756794 | 757489 |
| NZ_EQ973491.1 | *Bacteroides cellulosilyticus* | 755627 | 756205 |
| NZ_EQ973491.1 | *Bacteroides cellulosilyticus* | 811215 | 810535 |
| NZ_EQ973491.1 | *Bacteroides cellulosilyticus* | 810012 | 809638 |
| NZ_EQ973495.1 | *Bacteroides cellulosilyticus* | 70783 | 72162 |
| NZ_EQ973645.1 | *Bacteroides coprophilus* | 64693 | 66096 |
| NZ_GG667711.1 | *Hungatella hathewayi* | 24610 | 23903 |
| NZ_GG667711.1 | *Hungatella hathewayi* | 25807 | 25196 |
| NZ_GG688320.1 | *Bacteroides finegoldii* | 174406 | 173048 |
| NZ_GG688323.1 | *Bacteroides finegoldii* | 51406 | 50036 |
| NZ_GG688332.1 | *Bacteroides finegoldii* | 82694 | 82395 |
| NZ_GG703863.1 | *Prevotella copri* | 25172 | 26572 |
| NZ_JGDE01000072.1 | *Bacteroides fragilis* | 10558 | 11961 |
| NZ_JGDE01000126.1 | *Bacteroides fragilis* | 27194 | 27784 |
| NZ_JGDE01000126.1 | *Bacteroides fragilis* | 28379 | 29077 |
| NZ_JH724294.1 | *Bacteroides xylanisolvens* | 1911484 | 1912854 |
| NZ_JH724294.1 | *Bacteroides xylanisolvens* | 1590639 | 1589281 |
| NZ_JH724294.1 | *Bacteroides xylanisolvens* | 361730 | 362440 |
| NZ_JH724294.1 | *Bacteroides xylanisolvens* | 360536 | 361126 |
| NZ_JH724295.1 | *Bacteroides xylanisolvens* | 1623208 | 1624584 |
| NZ_JH724295.1 | *Bacteroides xylanisolvens* | 661738 | 660371 |
| NZ_JH724296.1 | *Bacteroides xylanisolvens* | 499153 | 497783 |
| NZ_JH724296.1 | *Bacteroides xylanisolvens* | 239797 | 241236 |
| NZ_JH724298.1 | *Bacteroides xylanisolvens* | 184281 | 184970 |
| NZ_JH724298.1 | *Bacteroides xylanisolvens* | 185469 | 185849 |
| NZ_PUEO01000004.1 | *Bacteroides thetaiotaomicron* | 951107 | 949671 |
| NZ_PUEO01000004.1 | *Bacteroides thetaiotaomicron* | 1015372 | 1014005 |
| NZ_PUEO01000004.1 | *Bacteroides thetaiotaomicron* | 964257 | 963661 |
| NZ_PUEO01000004.1 | *Bacteroides thetaiotaomicron* | 963054 | 962368 |
| NZ_PUEO01000014.1 | *Bacteroides thetaiotaomicron* | 2339682 | 2341040 |
| NZ_PUEO01000014.1 | *Bacteroides thetaiotaomicron* | 3014588 | 3013218 |
| NZ_PUEO01000014.1 | *Bacteroides thetaiotaomicron* | 184534 | 183164 |
| NZ_PUEO01000014.1 | *Bacteroides thetaiotaomicron* | 2364015 | 2365391 |
| NZ_PUEO01000014.1 | *Bacteroides thetaiotaomicron* | 868998 | 869705 |
| NZ_PUEO01000014.1 | *Bacteroides thetaiotaomicron* | 4023284 | 4022538 |
| NZ_PUEO01000014.1 | *Bacteroides thetaiotaomicron* | 867801 | 868409 |
| NZ_PUEO01000014.1 | *Bacteroides thetaiotaomicron* | 4024187 | 4023561 |
| NZ_PUEP01000005.1 | *Bacteroides ovatus* | 4831625 | 4832965 |
| NZ_PUEP01000005.1 | *Bacteroides ovatus* | 1909400 | 1910752 |
| NZ_PUEP01000005.1 | *Bacteroides ovatus* | 1450439 | 1449069 |
| NZ_PUEP01000005.1 | *Bacteroides ovatus* | 1919913 | 1918555 |
| NZ_PUEP01000005.1 | *Bacteroides ovatus* | 4675959 | 4677326 |
| NZ_PUEP01000005.1 | *Bacteroides ovatus* | 2987124 | 2985766 |
| NZ_PUEP01000005.1 | *Bacteroides ovatus* | 4995491 | 4994787 |
| NZ_PUEP01000005.1 | *Bacteroides ovatus* | 4996688 | 4996035 |
| NZ_PUEP01000005.1 | *Bacteroides ovatus* | 210770 | 211345 |
| NZ_PUEP01000005.1 | *Bacteroides ovatus* | 3955317 | 3955892 |
| NZ_PUEP01000005.1 | *Bacteroides ovatus* | 3956478 | 3957173 |
| NZ_PUEP01000005.1 | *Bacteroides ovatus* | 211955 | 212317 |
| NZ_PUEQ01000002.1 | *Bacteroides caccae* | 423398 | 424756 |
| NZ_PUEQ01000003.1 | *Bacteroides caccae* | 1528370 | 1526967 |
| NZ_UFTH01000001.1 | *Bacteroides fragilis* | 4051853 | 4053256 |
| NZ_UFTH01000001.1 | *Bacteroides fragilis* | 634929 | 635519 |
| NZ_UFTH01000001.1 | *Bacteroides fragilis* | 636114 | 636812 |
| QEKH01000001.1 | *Victivallis vadensis* | 296578 | 297354 |
| QEKH01000001.1 | *Victivallis vadensis* | 259902 | 259210 |
| QEKH01000001.1 | *Victivallis vadensis* | 295345 | 295962 |
| QEKH01000001.1 | *Victivallis vadensis* | 261147 | 260575 |
| QEKH01000003.1 | *Victivallis vadensis* | 120748 | 122115 |
| QEKH01000011.1 | *Victivallis vadensis* | 39979 | 38537 |
| QEKH01000018.1 | *Victivallis vadensis* | 24528 | 23029 |
| QEKH01000033.1 | *Victivallis vadensis* | 47019 | 45649 |
| QEKH01000042.1 | *Victivallis vadensis* | 3416 | 4150 |
| QEKH01000042.1 | *Victivallis vadensis* | 2183 | 2791 |
| BACDOR_00665 | | 45 | 104 |
| BACDOR_03379 | | 212 | 273 |
| BT_0569 | | 40 | 231 |
| BT_2961 | | 214 | 271 |
| BT_4096 | | 3 | 460 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| CVOZ01000033.1 | Bacteroides thetaiotaomicron | 99605 | 98205 |
| CVOZ01000033.1 | Bacteroides thetaiotaomicron | 61396 | 60014 |
| NC_009615.1 | Parabacteroides distasonis | 264706 | 266067 |
| NC_009615.1 | Parabacteroides distasonis | 3795050 | 3796402 |
| NZ_CVOY01000004.1 | Bacteroides thetaiotaomicron | 11010 | 12392 |
| NZ_CVOY01000007.1 | Bacteroides thetaiotaomicron | 27423 | 26023 |
| NZ_DS264584.1 | Bacteroides ovatus | 251782 | 253182 |
| NZ_DS264584.1 | Bacteroides ovatus | 279314 | 280687 |
| NZ_JH724294.1 | Bacteroides xylanisolvens | 336113 | 337513 |
| NZ_JH724294.1 | Bacteroides xylanisolvens | 368251 | 369624 |
| NZ_JH724294.1 | Bacteroides xylanisolvens | 357519 | 358895 |
| NZ_PUEO01000014.1 | Bacteroides thetaiotaomicron | 838901 | 840301 |
| NZ_PUEO01000014.1 | Bacteroides thetaiotaomicron | 877110 | 878492 |
| NZ_PUEP01000005.1 | Bacteroides ovatus | 3193968 | 3192568 |
| NZ_PUEP01000005.1 | Bacteroides ovatus | 3166436 | 3165063 |
| QEKH01000001.1 | Victivallis vadensis | 132621 | 131368 |
| QEKH01000002.1 | Victivallis vadensis | 100395 | 99751 |
| QEKH01000021.1 | Victivallis vadensis | 86373 | 87041 |
| QEKH01000042.1 | Victivallis vadensis | 14734 | 15321 |
| BT_3124 | | 241 | 479 |
| BT_3124 | | 3 | 228 |
| CVOZ01000011.1 | Bacteroides thetaiotaomicron | 74620 | 75276 |
| CVOZ01000011.1 | Bacteroides thetaiotaomicron | 33827 | 34531 |
| CVOZ01000011.1 | Bacteroides thetaiotaomicron | 75238 | 76062 |
| CVOZ01000011.1 | Bacteroides thetaiotaomicron | 33134 | 33793 |
| CVOZ01000021.1 | Bacteroides thetaiotaomicron | 107432 | 108184 |
| CVOZ01000021.1 | Bacteroides thetaiotaomicron | 106475 | 107299 |
| CVOZ01000033.1 | Bacteroides thetaiotaomicron | 70763 | 68778 |
| CVOZ01000041.1 | Bacteroides thetaiotaomicron | 303958 | 304608 |
| CVOZ01000041.1 | Bacteroides thetaiotaomicron | 304672 | 305376 |
| CVOZ01000043.1 | Bacteroides thetaiotaomicron | 101498 | 103327 |
| CVOZ01000043.1 | Bacteroides thetaiotaomicron | 115294 | 116010 |
| CVOZ01000043.1 | Bacteroides thetaiotaomicron | 64239 | 64898 |
| CVOZ01000043.1 | Bacteroides thetaiotaomicron | 114580 | 115257 |
| CVOZ01000043.1 | Bacteroides thetaiotaomicron | 64962 | 65666 |
| CVOZ01000044.1 | Bacteroides thetaiotaomicron | 11540 | 12187 |
| CVOZ01000044.1 | Bacteroides thetaiotaomicron | 30408 | 31103 |
| CVOZ01000044.1 | Bacteroides thetaiotaomicron | 31080 | 31790 |
| CVOZ01000044.1 | Bacteroides thetaiotaomicron | 55437 | 56120 |
| CVOZ01000044.1 | Bacteroides thetaiotaomicron | 12212 | 12922 |
| CVOZ01000044.1 | Bacteroides thetaiotaomicron | 54720 | 55550 |
| CVOZ01000045.1 | Bacteroides thetaiotaomicron | 113179 | 113826 |
| CVOZ01000045.1 | Bacteroides thetaiotaomicron | 113845 | 114579 |
| JGCP01000263.1 | Bacteroides fragilis | 858 | 211 |
| JGCP01000263.1 | Bacteroides fragilis | 171 | 1 |
| JGCP01000476.1 | Bacteroides fragilis | 900 | 43 |
| JGCP01000476.1 | Bacteroides fragilis | 1149 | 802 |
| JGCP01001016.1 | Bacteroides fragilis | 8 | 328 |
| JGCP01001396.1 | Bacteroides fragilis | 1381 | 2091 |
| JGCP01001396.1 | Bacteroides fragilis | 664 | 1266 |
| JGCP01001637.1 | Bacteroides fragilis | 489 | 7 |
| JGCP01001863.1 | Bacteroides fragilis | 1705 | 1019 |
| JGCP01001863.1 | Bacteroides fragilis | 2422 | 1820 |
| JGCP01002441.1 | Bacteroides fragilis | 11796 | 12482 |
| JGCP01002441.1 | Bacteroides fragilis | 11079 | 11681 |
| JGCP01002533.1 | Bacteroides fragilis | 3435 | 5387 |
| NC_008618.1 | Bifidobacterium adolescentis | 539801 | 541717 |
| NC_008618.1 | Bifidobacterium adolescentis | 113920 | 114804 |
| NC_008618.1 | Bifidobacterium adolescentis | 113092 | 114030 |
| NC_008618.1 | Bifidobacterium adolescentis | 393068 | 393487 |
| NC_008618.1 | Bifidobacterium adolescentis | 1901057 | 1901710 |
| NC_009614.1 | Bacteroides vulgatus | 1019192 | 1017240 |
| NC_009614.1 | Bacteroides vulgatus | 4736413 | 4738329 |
| NC_009614.1 | Bacteroides vulgatus | 36139 | 34268 |
| NC_009614.1 | Bacteroides vulgatus | 3437145 | 3437807 |
| NC_009614.1 | Bacteroides vulgatus | 5098297 | 5097611 |
| NC_009614.1 | Bacteroides vulgatus | 3437826 | 3438560 |
| NC_009614.1 | Bacteroides vulgatus | 5099014 | 5098412 |
| NC_009615.1 | Parabacteroides distasonis | 3530692 | 3531420 |
| NC_009615.1 | Parabacteroides distasonis | 58080 | 57307 |
| NC_009615.1 | Parabacteroides distasonis | 58722 | 58066 |
| NC_009615.1 | Parabacteroides distasonis | 3530017 | 3530631 |
| NC_010655.1 | Akkermansia muciniphila | 542610 | 543332 |
| NC_010655.1 | Akkermansia muciniphila | 541896 | 542486 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_AAVM02000001.1 | Bacteroides caccae | 1238844 | 1238158 |
| NZ_AAVM02000001.1 | Bacteroides caccae | 1239561 | 1238959 |
| NZ_AAVM02000005.1 | Bacteroides caccae | 57149 | 57871 |
| NZ_AAVM02000005.1 | Bacteroides caccae | 56462 | 57106 |
| NZ_ABJL02000002.1 | Bacteroides intestinalis | 239465 | 238749 |
| NZ_ABJL02000002.1 | Bacteroides intestinalis | 240158 | 239496 |
| NZ_ABJL02000006.1 | Bacteroides intestinalis | 172436 | 172182 |
| NZ_ABJL02000007.1 | Bacteroides intestinalis | 507881 | 509830 |
| NZ_ABJL02000007.1 | Bacteroides intestinalis | 720668 | 721381 |
| NZ_ABJL02000007.1 | Bacteroides intestinalis | 719873 | 720490 |
| NZ_ABJL02000008.1 | Bacteroides intestinalis | 2526443 | 2524545 |
| NZ_ABJL02000008.1 | Bacteroides intestinalis | 2484163 | 2485770 |
| NZ_ABJL02000008.1 | Bacteroides intestinalis | 944772 | 945464 |
| NZ_ABJL02000008.1 | Bacteroides intestinalis | 3168665 | 3167952 |
| NZ_ABJL02000008.1 | Bacteroides intestinalis | 3174590 | 3175297 |
| NZ_ABJL02000008.1 | Bacteroides intestinalis | 3169325 | 3168690 |
| NZ_ABJL02000008.1 | Bacteroides intestinalis | 944064 | 944690 |
| NZ_ABJL02000008.1 | Bacteroides intestinalis | 3173903 | 3174544 |
| NZ_ACCL02000028.1 | Marvinbryantia formatexigens | 16369 | 18624 |
| NZ_ATFI01000001.1 | Bacteroides cellulosilyticus | 717919 | 715976 |
| NZ_ATFI01000001.1 | Bacteroides cellulosilyticus | 1753709 | 1755610 |
| NZ_ATFI01000001.1 | Bacteroides cellulosilyticus | 341321 | 339480 |
| NZ_ATFI01000001.1 | Bacteroides cellulosilyticus | 176816 | 176448 |
| NZ_ATFI01000004.1 | Bacteroides cellulosilyticus | 665353 | 664640 |
| NZ_ATFI01000004.1 | Bacteroides cellulosilyticus | 634622 | 635347 |
| NZ_ATFI01000004.1 | Bacteroides cellulosilyticus | 666022 | 665381 |
| NZ_ATFI01000004.1 | Bacteroides cellulosilyticus | 635333 | 636016 |
| NZ_ATFI01000004.1 | Bacteroides cellulosilyticus | 636062 | 636697 |
| NZ_ATFI01000004.1 | Bacteroides cellulosilyticus | 747630 | 746851 |
| NZ_ATFI01000004.1 | Bacteroides cellulosilyticus | 668414 | 669118 |
| NZ_ATFI01000004.1 | Bacteroides cellulosilyticus | 667739 | 668365 |
| NZ_ATFI01000004.1 | Bacteroides cellulosilyticus | 748281 | 747637 |
| NZ_ATFI01000004.1 | Bacteroides cellulosilyticus | 636749 | 637447 |
| NZ_ATFI01000009.1 | Bacteroides cellulosilyticus | 345823 | 343925 |
| NZ_ATFI01000009.1 | Bacteroides cellulosilyticus | 291172 | 292779 |
| NZ_ATFI01000010.1 | Bacteroides cellulosilyticus | 116525 | 115881 |
| NZ_ATFI01000010.1 | Bacteroides cellulosilyticus | 115862 | 115128 |
| NZ_ATFI01000013.1 | Bacteroides cellulosilyticus | 165564 | 164869 |
| NZ_ATFI01000013.1 | Bacteroides cellulosilyticus | 166287 | 165634 |
| NZ_CVOY01000004.1 | Bacteroides thetaiotaomicron | 1642 | 3627 |
| NZ_CVOY01000015.1 | Bacteroides thetaiotaomicron | 29805 | 30452 |
| NZ_CVOY01000015.1 | Bacteroides thetaiotaomicron | 30471 | 31205 |
| NZ_CVOY01000028.1 | Bacteroides thetaiotaomicron | 92593 | 93243 |
| NZ_CVOY01000028.1 | Bacteroides thetaiotaomicron | 93307 | 94011 |
| NZ_CVOY01000029.1 | Bacteroides thetaiotaomicron | 122462 | 123130 |
| NZ_CVOY01000029.1 | Bacteroides thetaiotaomicron | 123170 | 123865 |
| NZ_CVOY01000041.1 | Bacteroides thetaiotaomicron | 65807 | 65124 |
| NZ_CVOY01000041.1 | Bacteroides thetaiotaomicron | 66524 | 65694 |
| NZ_CVOY01000043.1 | Bacteroides thetaiotaomicron | 51501 | 52160 |
| NZ_CVOY01000043.1 | Bacteroides thetaiotaomicron | 52224 | 52928 |
| NZ_CVOY01000050.1 | Bacteroides thetaiotaomicron | 6722 | 8662 |
| NZ_CVOY01000050.1 | Bacteroides thetaiotaomicron | 20636 | 21352 |
| NZ_CVOY01000050.1 | Bacteroides thetaiotaomicron | 19922 | 20599 |
| NZ_CVOY01000089.1 | Bacteroides thetaiotaomicron | 11273 | 12025 |
| NZ_CVOY01000089.1 | Bacteroides thetaiotaomicron | 10316 | 11140 |
| NZ_CVOY01000094.1 | Bacteroides thetaiotaomicron | 136 | 846 |
| NZ_CVOY01000102.1 | Bacteroides thetaiotaomicron | 4081 | 3434 |
| NZ_CVOY01000102.1 | Bacteroides thetaiotaomicron | 3409 | 2699 |
| NZ_CVOY01000120.1 | Bacteroides thetaiotaomicron | 2007 | 2552 |
| NZ_DS264461.1 | Parabacteroides merdae | 327354 | 328088 |
| NZ_DS264461.1 | Parabacteroides merdae | 326694 | 327290 |
| NZ_DS264553.1 | Bacteroides ovatus | 485214 | 484567 |
| NZ_DS264553.1 | Bacteroides ovatus | 484548 | 483814 |
| NZ_DS264563.1 | Bacteroides ovatus | 230064 | 230708 |
| NZ_DS264563.1 | Bacteroides ovatus | 240646 | 239993 |
| NZ_DS264563.1 | Bacteroides ovatus | 240010 | 239249 |
| NZ_DS264563.1 | Bacteroides ovatus | 230733 | 231446 |
| NZ_DS264579.1 | Bacteroides ovatus | 25214 | 27115 |
| NZ_DS264579.1 | Bacteroides ovatus | 189683 | 188934 |
| NZ_DS264579.1 | Bacteroides ovatus | 345420 | 344563 |
| NZ_DS264579.1 | Bacteroides ovatus | 190319 | 189654 |
| NZ_DS264579.1 | Bacteroides ovatus | 345930 | 345322 |
| NZ_DS264581.1 | Bacteroides ovatus | 194006 | 192096 |
| NZ_DS264583.1 | Bacteroides ovatus | 294027 | 292444 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS264584.1 | Bacteroides ovatus | 459309 | 460004 |
| NZ_DS264584.1 | Bacteroides ovatus | 458592 | 459305 |
| NZ_DS264584.1 | Bacteroides ovatus | 273310 | 273522 |
| NZ_DS362248.1 | Bacteroides uniformis | 463033 | 462248 |
| NZ_DS362248.1 | Bacteroides uniformis | 463663 | 463004 |
| NZ_DS362248.1 | Bacteroides uniformis | 44192 | 44803 |
| NZ_DS362248.1 | Bacteroides uniformis | 44831 | 45532 |
| NZ_DS499654.1 | Erysipelatoclostridium ramosum | 459551 | 460294 |
| NZ_DS499654.1 | Erysipelatoclostridium ramosum | 458840 | 459829 |
| NZ_DS499669.1 | Bacteroides stercoris | 55347 | 54652 |
| NZ_DS499669.1 | Bacteroides stercoris | 56085 | 55366 |
| NZ_DS499673.1 | Bacteroides stercoris | 494828 | 495712 |
| NZ_DS499673.1 | Bacteroides stercoris | 494264 | 494887 |
| NZ_DS995509.1 | Bacteroides eggerthii | 774444 | 776297 |
| NZ_DS995509.1 | Bacteroides eggerthii | 772192 | 770606 |
| NZ_DS995509.1 | Bacteroides eggerthii | 43167 | 43862 |
| NZ_DS995509.1 | Bacteroides eggerthii | 43842 | 44582 |
| NZ_DS995510.1 | Bacteroides eggerthii | 529121 | 529825 |
| NZ_DS995510.1 | Bacteroides eggerthii | 501722 | 501018 |
| NZ_DS995510.1 | Bacteroides eggerthii | 528449 | 529084 |
| NZ_DS995510.1 | Bacteroides eggerthii | 502442 | 501771 |
| NZ_DS995510.1 | Bacteroides eggerthii | 205068 | 205853 |
| NZ_DS995510.1 | Bacteroides eggerthii | 204429 | 205115 |
| NZ_DS995511.1 | Bacteroides eggerthii | 377907 | 377200 |
| NZ_DS995511.1 | Bacteroides eggerthii | 444934 | 444194 |
| NZ_DS995511.1 | Bacteroides eggerthii | 320605 | 319916 |
| NZ_DS995511.1 | Bacteroides eggerthii | 319891 | 319190 |
| NZ_DS995511.1 | Bacteroides eggerthii | 445651 | 445079 |
| NZ_DS995511.1 | Bacteroides eggerthii | 378660 | 378064 |
| NZ_DS995531.1 | Bacteroides dorei | 312233 | 314116 |
| NZ_DS995531.1 | Bacteroides dorei | 449795 | 450535 |
| NZ_DS995531.1 | Bacteroides dorei | 372209 | 372925 |
| NZ_DS995531.1 | Bacteroides dorei | 371504 | 372148 |
| NZ_DS995531.1 | Bacteroides dorei | 449132 | 449734 |
| NZ_DS995533.1 | Bacteroides dorei | 2999 | 1083 |
| NZ_DS995537.1 | Bacteroides dorei | 920175 | 920837 |
| NZ_DS995537.1 | Bacteroides dorei | 920856 | 921590 |
| NZ_DS995538.1 | Bacteroides dorei | 46977 | 45025 |
| NZ_DS996444.1 | Parabacteroides johnsonii | 269793 | 268207 |
| NZ_DS996444.1 | Parabacteroides johnsonii | 536038 | 536772 |
| NZ_DS996444.1 | Parabacteroides johnsonii | 535381 | 535974 |
| NZ_EQ973486.1 | Bacteroides cellulosilyticus | 126700 | 127413 |
| NZ_EQ973486.1 | Bacteroides cellulosilyticus | 157765 | 157040 |
| NZ_EQ973486.1 | Bacteroides cellulosilyticus | 157054 | 156371 |
| NZ_EQ973486.1 | Bacteroides cellulosilyticus | 156325 | 155690 |
| NZ_EQ973486.1 | Bacteroides cellulosilyticus | 126031 | 126672 |
| NZ_EQ973486.1 | Bacteroides cellulosilyticus | 123385 | 122681 |
| NZ_EQ973486.1 | Bacteroides cellulosilyticus | 43489 | 43956 |
| NZ_EQ973486.1 | Bacteroides cellulosilyticus | 43994 | 44269 |
| NZ_EQ973486.1 | Bacteroides cellulosilyticus | 124060 | 123434 |
| NZ_EQ973486.1 | Bacteroides cellulosilyticus | 42838 | 43482 |
| NZ_EQ973486.1 | Bacteroides cellulosilyticus | 155638 | 154940 |
| NZ_EQ973490.1 | Bacteroides cellulosilyticus | 811780 | 810014 |
| NZ_EQ973490.1 | Bacteroides cellulosilyticus | 1963581 | 1965482 |
| NZ_EQ973490.1 | Bacteroides cellulosilyticus | 447004 | 445163 |
| NZ_EQ973490.1 | Bacteroides cellulosilyticus | 50033 | 49338 |
| NZ_EQ973490.1 | Bacteroides cellulosilyticus | 50756 | 50103 |
| NZ_EQ973490.1 | Bacteroides cellulosilyticus | 791221 | 791045 |
| NZ_EQ973490.1 | Bacteroides cellulosilyticus | 276595 | 276227 |
| NZ_EQ973491.1 | Bacteroides cellulosilyticus | 755591 | 757489 |
| NZ_EQ973491.1 | Bacteroides cellulosilyticus | 811248 | 809641 |
| NZ_EQ973491.1 | Bacteroides cellulosilyticus | 107495 | 108139 |
| NZ_EQ973491.1 | Bacteroides cellulosilyticus | 108158 | 108793 |
| NZ_EQ973495.1 | Bacteroides cellulosilyticus | 71470 | 72162 |
| NZ_EQ973495.1 | Bacteroides cellulosilyticus | 70762 | 71388 |
| NZ_EQ973645.1 | Bacteroides coprophilus | 65398 | 66096 |
| NZ_EQ973645.1 | Bacteroides coprophilus | 64693 | 65487 |
| NZ_GG667711.1 | Hungatella hathewayi | 25792 | 23903 |
| NZ_GG688320.1 | Bacteroides finegoldii | 173722 | 173027 |
| NZ_GG688320.1 | Bacteroides finegoldii | 174439 | 173726 |
| NZ_GG688323.1 | Bacteroides finegoldii | 51433 | 50789 |
| NZ_GG688323.1 | Bacteroides finegoldii | 50770 | 50036 |
| NZ_GG703863.1 | Prevotella copri | 25121 | 25768 |
| NZ_GG703863.1 | Prevotella copri | 25823 | 26572 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_JGDE01000072.1 | *Bacteroides fragilis* | 11275 | 11961 |
| NZ_JGDE01000072.1 | *Bacteroides fragilis* | 10558 | 11160 |
| NZ_JGDE01000126.1 | *Bacteroides fragilis* | 27137 | 29089 |
| NZ_JH724294.1 | *Bacteroides xylanisolvens* | 360479 | 362464 |
| NZ_JH724294.1 | *Bacteroides xylanisolvens* | 1911454 | 1912101 |
| NZ_JH724294.1 | *Bacteroides xylanisolvens* | 1590663 | 1590019 |
| NZ_JH724294.1 | *Bacteroides xylanisolvens* | 1912120 | 1912854 |
| NZ_JH724294.1 | *Bacteroides xylanisolvens* | 1589994 | 1589281 |
| NZ_JH724295.1 | *Bacteroides xylanisolvens* | 1623178 | 1623825 |
| NZ_JH724295.1 | *Bacteroides xylanisolvens* | 661219 | 660362 |
| NZ_JH724295.1 | *Bacteroides xylanisolvens* | 661729 | 661121 |
| NZ_JH724295.1 | *Bacteroides xylanisolvens* | 1623793 | 1624593 |
| NZ_JH724296.1 | *Bacteroides xylanisolvens* | 240529 | 241266 |
| NZ_JH724296.1 | *Bacteroides xylanisolvens* | 499186 | 498554 |
| NZ_JH724296.1 | *Bacteroides xylanisolvens* | 498484 | 497780 |
| NZ_JH724296.1 | *Bacteroides xylanisolvens* | 239746 | 240348 |
| NZ_JH724298.1 | *Bacteroides xylanisolvens* | 184254 | 185849 |
| NZ_PUEO01000004.1 | *Bacteroides thetaiotaomicron* | 964302 | 962362 |
| NZ_PUEO01000004.1 | *Bacteroides thetaiotaomicron* | 950387 | 949671 |
| NZ_PUEO01000004.1 | *Bacteroides thetaiotaomicron* | 1015423 | 1014764 |
| NZ_PUEO01000004.1 | *Bacteroides thetaiotaomicron* | 951101 | 950424 |
| NZ_PUEO01000004.1 | *Bacteroides thetaiotaomicron* | 1014700 | 1013996 |
| NZ_PUEO01000014.1 | *Bacteroides thetaiotaomicron* | 867744 | 869729 |
| NZ_PUEO01000014.1 | *Bacteroides thetaiotaomicron* | 4023290 | 4022538 |
| NZ_PUEO01000014.1 | *Bacteroides thetaiotaomicron* | 3014618 | 3013971 |
| NZ_PUEO01000014.1 | *Bacteroides thetaiotaomicron* | 3013952 | 3013218 |
| NZ_PUEO01000014.1 | *Bacteroides thetaiotaomicron* | 2339658 | 2340353 |
| NZ_PUEO01000014.1 | *Bacteroides thetaiotaomicron* | 2340330 | 2341040 |
| NZ_PUEO01000014.1 | *Bacteroides thetaiotaomicron* | 184582 | 183932 |
| NZ_PUEO01000014.1 | *Bacteroides thetaiotaomicron* | 2364708 | 2365391 |
| NZ_PUEO01000014.1 | *Bacteroides thetaiotaomicron* | 183868 | 183164 |
| NZ_PUEO01000014.1 | *Bacteroides thetaiotaomicron* | 4024199 | 4023423 |
| NZ_PUEO01000014.1 | *Bacteroides thetaiotaomicron* | 2363991 | 2364821 |
| NZ_PUEP01000005.1 | *Bacteroides ovatus* | 4996688 | 4994787 |
| NZ_PUEP01000005.1 | *Bacteroides ovatus* | 3955263 | 3957173 |
| NZ_PUEP01000005.1 | *Bacteroides ovatus* | 210740 | 212323 |
| NZ_PUEP01000005.1 | *Bacteroides ovatus* | 2986440 | 2985745 |
| NZ_PUEP01000005.1 | *Bacteroides ovatus* | 1450469 | 1449822 |
| NZ_PUEP01000005.1 | *Bacteroides ovatus* | 4832216 | 4832965 |
| NZ_PUEP01000005.1 | *Bacteroides ovatus* | 1919937 | 1919293 |
| NZ_PUEP01000005.1 | *Bacteroides ovatus* | 1909355 | 1910008 |
| NZ_PUEP01000005.1 | *Bacteroides ovatus* | 1449803 | 1449069 |
| NZ_PUEP01000005.1 | *Bacteroides ovatus* | 2987157 | 2986444 |
| NZ_PUEP01000005.1 | *Bacteroides ovatus* | 1909991 | 1910752 |
| NZ_PUEP01000005.1 | *Bacteroides ovatus* | 1919268 | 1918555 |
| NZ_PUEP01000005.1 | *Bacteroides ovatus* | 4676478 | 4677335 |
| NZ_PUEP01000005.1 | *Bacteroides ovatus* | 4831580 | 4832245 |
| NZ_PUEP01000005.1 | *Bacteroides ovatus* | 4675968 | 4676576 |
| NZ_PUEP01000005.1 | *Bacteroides ovatus* | 3172440 | 3172228 |
| NZ_PUEQ01000002.1 | *Bacteroides caccae* | 424034 | 424756 |
| NZ_PUEQ01000002.1 | *Bacteroides caccae* | 423347 | 423991 |
| NZ_PUEQ01000003.1 | *Bacteroides caccae* | 1527653 | 1526967 |
| NZ_PUEQ01000003.1 | *Bacteroides caccae* | 1528370 | 1527768 |
| NZ_UFTH01000001.1 | *Bacteroides fragilis* | 634872 | 636824 |
| NZ_UFTH01000001.1 | *Bacteroides fragilis* | 4052570 | 4053256 |
| NZ_UFTH01000001.1 | *Bacteroides fragilis* | 4051853 | 4052455 |
| QEKH01000001.1 | *Victivallis vadensis* | 261147 | 259213 |
| QEKH01000001.1 | *Victivallis vadensis* | 295375 | 297354 |
| QEKH01000001.1 | *Victivallis vadensis* | 174465 | 174815 |
| QEKH01000003.1 | *Victivallis vadensis* | 121426 | 122112 |
| QEKH01000003.1 | *Victivallis vadensis* | 120697 | 121353 |
| QEKH01000005.1 | *Victivallis vadensis* | 102693 | 102322 |
| QEKH01000011.1 | *Victivallis vadensis* | 39211 | 38537 |
| QEKH01000011.1 | *Victivallis vadensis* | 39979 | 39317 |
| QEKH01000017.1 | *Victivallis vadensis* | 5676 | 5230 |
| QEKH01000018.1 | *Victivallis vadensis* | 24540 | 23800 |
| QEKH01000018.1 | *Victivallis vadensis* | 23730 | 23017 |
| QEKH01000026.1 | *Victivallis vadensis* | 59633 | 60028 |
| QEKH01000033.1 | *Victivallis vadensis* | 46335 | 45649 |
| QEKH01000033.1 | *Victivallis vadensis* | 47037 | 46432 |
| QEKH01000042.1 | *Victivallis vadensis* | 2180 | 4150 |
| BACDOR_00665 | | 24 | 209 |
| BT_0569 | | 39 | 231 |
| BT_1192 | | 267 | 452 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| BT_2961 | | 11 | 271 |
| BT_4075 | | 8 | 466 |
| CVOZ01000033.1 | Bacteroides thetaiotaomicron | 61393 | 60014 |
| CVOZ01000033.1 | Bacteroides thetaiotaomicron | 99584 | 98208 |
| NC_009615.1 | Parabacteroides distasonis | 3795026 | 3796402 |
| NC_009615.1 | Parabacteroides distasonis | 264697 | 266070 |
| NZ_CVOY01000004.1 | Bacteroides thetaiotaomicron | 11013 | 12392 |
| NZ_CVOY01000007.1 | Bacteroides thetaiotaomicron | 27402 | 26026 |
| NZ_DS264584.1 | Bacteroides ovatus | 279308 | 280687 |
| NZ_DS264584.1 | Bacteroides ovatus | 251803 | 253182 |
| NZ_DS362240.1 | Bacteroides uniformis | 192340 | 193038 |
| NZ_DS996453.1 | Parabacteroides johnsonii | 23050 | 22433 |
| NZ_JH724294.1 | Bacteroides xylanisolvens | 368245 | 369624 |
| NZ_JH724294.1 | Bacteroides xylanisolvens | 357525 | 358895 |
| NZ_JH724294.1 | Bacteroides xylanisolvens | 336134 | 337513 |
| NZ_PUEO01000014.1 | Bacteroides thetaiotaomicron | 877113 | 878492 |
| NZ_PUEO01000014.1 | Bacteroides thetaiotaomicron | 838922 | 840298 |
| NZ_PUEP01000005.1 | Bacteroides ovatus | 3166442 | 3165063 |
| NZ_PUEP01000005.1 | Bacteroides ovatus | 3193947 | 3192568 |
| QEKH01000001.1 | Victivallis vadensis | 132621 | 131698 |
| QEKH01000001.1 | Victivallis vadensis | 111338 | 110643 |
| QEKH01000042.1 | Victivallis vadensis | 14734 | 15336 |
| BT_1192 | | 274 | 391 |
| NZ_AAVN02000001.1 | Collinsella aerofaciens | 309869 | 309213 |
| NZ_ACCL02000001.1 | Marvinbryantia formatexigens | 196740 | 197378 |
| NZ_ACEP01000075.1 | Eubacterium hallii | 1967 | 2593 |
| NZ_DS480699.1 | Clostridium bolteae | 56611 | 57216 |
| NZ_DS544183.1 | Anaerotruncus colihominis | 164934 | 165578 |
| NZ_DS990202.1 | Ruminococcus lactaris | 95396 | 94794 |
| NZ_DS996840.1 | Holdemanella biformis | 66548 | 65937 |
| NZ_GG657592.1 | Clostridium asparagiforme | 526631 | 526026 |
| NZ_GG662012.1 | Coprococcus comes | 180676 | 180056 |
| NZ_GG667621.1 | Hungatella hathewayi | 56888 | 57523 |
| NZ_GG692722.1 | Roseburia intestinalis | 63578 | 62997 |
| NZ_PUEM01000006.1 | Clostridium bolteae | 96643 | 97248 |
| CVOZ01000005.1 | Bacteroides thetaiotaomicron | 57756 | 58391 |
| CVOZ01000006.1 | Bacteroides thetaiotaomicron | 30425 | 31405 |
| CVOZ01000006.1 | Bacteroides thetaiotaomicron | 3549 | 4445 |
| CVOZ01000032.1 | Bacteroides thetaiotaomicron | 285470 | 284589 |
| CVOZ01000033.1 | Bacteroides thetaiotaomicron | 41117 | 40113 |
| CVOZ01000045.1 | Bacteroides thetaiotaomicron | 65855 | 64761 |
| JGCP01000292.1 | Bacteroides fragilis | 188 | 1129 |
| JGCP01000923.1 | Bacteroides fragilis | 469 | 2 |
| JGCP01001315.1 | Bacteroides fragilis | 1656 | 1096 |
| JGCP01001936.1 | Bacteroides fragilis | 2158 | 2640 |
| NC_009614.1 | Bacteroides vulgatus | 3354933 | 3356018 |
| NC_009614.1 | Bacteroides vulgatus | 2447171 | 2446089 |
| NC_009614.1 | Bacteroides vulgatus | 2316235 | 2317242 |
| NC_009614.1 | Bacteroides vulgatus | 1754976 | 1755668 |
| NC_009614.1 | Bacteroides vulgatus | 229513 | 228737 |
| NZ_AAVM02000003.1 | Bacteroides caccae | 185072 | 186076 |
| NZ_AAVN02000002.1 | Collinsella aerofaciens | 330089 | 328836 |
| NZ_AAYG02000009.1 | Ruminococcus gnavus | 76928 | 78010 |
| NZ_AAYG02000020.1 | Ruminococcus gnavus | 155246 | 154575 |
| NZ_ABJL02000006.1 | Bacteroides intestinalis | 172076 | 171060 |
| NZ_ABJL02000006.1 | Bacteroides intestinalis | 163000 | 161969 |
| NZ_ABJL02000007.1 | Bacteroides intestinalis | 472617 | 473339 |
| NZ_ABJL02000007.1 | Bacteroides intestinalis | 480076 | 480798 |
| NZ_ABJL02000008.1 | Bacteroides intestinalis | 2829172 | 2828048 |
| NZ_ABJL02000008.1 | Bacteroides intestinalis | 1177965 | 1176991 |
| NZ_ABJL02000008.1 | Bacteroides intestinalis | 1188047 | 1187424 |
| NZ_ATFI01000001.1 | Bacteroides cellulosilyticus | 967512 | 968423 |
| NZ_ATFI01000001.1 | Bacteroides cellulosilyticus | 822055 | 822963 |
| NZ_ATFI01000001.1 | Bacteroides cellulosilyticus | 746022 | 745300 |
| NZ_ATFI01000004.1 | Bacteroides cellulosilyticus | 196151 | 195027 |
| NZ_ATFI01000008.1 | Bacteroides cellulosilyticus | 349394 | 350368 |
| NZ_ATFI01000008.1 | Bacteroides cellulosilyticus | 448433 | 449446 |
| NZ_ATFI01000008.1 | Bacteroides cellulosilyticus | 339279 | 339935 |
| NZ_ATFI01000010.1 | Bacteroides cellulosilyticus | 52643 | 53737 |
| NZ_ATFI01000013.1 | Bacteroides cellulosilyticus | 164808 | 163792 |
| NZ_ATFI01000013.1 | Bacteroides cellulosilyticus | 152238 | 151207 |
| NZ_ATFI01000018.1 | Bacteroides cellulosilyticus | 141668 | 142606 |
| NZ_ATFI01000018.1 | Bacteroides cellulosilyticus | 132297 | 133130 |
| NZ_CVOY01000002.1 | Bacteroides thetaiotaomicron | 3895 | 4776 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_CVOY01000004.1 | Bacteroides thetaiotaomicron | 31282 | 32286 |
| NZ_CVOY01000033.1 | Bacteroides thetaiotaomicron | 54890 | 55870 |
| NZ_CVOY01000047.1 | Bacteroides thetaiotaomicron | 51696 | 52331 |
| NZ_CVOY01000055.1 | Bacteroides thetaiotaomicron | 60965 | 59871 |
| NZ_DS264461.1 | Parabacteroides merdae | 153316 | 152396 |
| NZ_DS264554.1 | Bacteroides ovatus | 520925 | 520290 |
| NZ_DS264582.1 | Bacteroides ovatus | 485007 | 483871 |
| NZ_DS264584.1 | Bacteroides ovatus | 299154 | 300158 |
| NZ_DS264584.1 | Bacteroides ovatus | 459996 | 461081 |
| NZ_DS264584.1 | Bacteroides ovatus | 422114 | 422995 |
| NZ_DS480676.1 | Clostridium bolteae | 33135 | 34307 |
| NZ_DS480689.1 | Clostridium bolteae | 189055 | 188054 |
| NZ_DS480702.1 | Clostridium bolteae | 114722 | 114084 |
| NZ_DS499669.1 | Bacteroides stercoris | 54603 | 53575 |
| NZ_DS499669.1 | Bacteroides stercoris | 41098 | 40067 |
| NZ_DS499676.1 | Bacteroides stercoris | 563727 | 562723 |
| NZ_DS995509.1 | Bacteroides eggerthii | 324943 | 326016 |
| NZ_DS995509.1 | Bacteroides eggerthii | 32959 | 31790 |
| NZ_DS995531.1 | Bacteroides dorei | 131233 | 132258 |
| NZ_DS995534.1 | Bacteroides dorei | 665227 | 665934 |
| NZ_DS995536.1 | Bacteroides dorei | 158689 | 159771 |
| NZ_DS995536.1 | Bacteroides dorei | 286827 | 285820 |
| NZ_DS995537.1 | Bacteroides dorei | 839046 | 840131 |
| NZ_DS996445.1 | Parabacteroides johnsonii | 309779 | 310801 |
| NZ_DS996453.1 | Parabacteroides johnsonii | 946 | 44 |
| NZ_DS996453.1 | Parabacteroides johnsonii | 541071 | 541673 |
| NZ_DS996921.1 | Bacteroides pectinophilus | 1792409 | 1793536 |
| NZ_DS996921.1 | Bacteroides pectinophilus | 1408311 | 1409351 |
| NZ_EQ973488.1 | Bacteroides cellulosilyticus | 305101 | 305769 |
| NZ_EQ973488.1 | Bacteroides cellulosilyticus | 318355 | 318765 |
| NZ_EQ973489.1 | Bacteroides cellulosilyticus | 401883 | 400945 |
| NZ_EQ973489.1 | Bacteroides cellulosilyticus | 411254 | 410421 |
| NZ_EQ973490.1 | Bacteroides cellulosilyticus | 49277 | 48261 |
| NZ_EQ973490.1 | Bacteroides cellulosilyticus | 1172225 | 1173136 |
| NZ_EQ973490.1 | Bacteroides cellulosilyticus | 36535 | 35504 |
| NZ_EQ973490.1 | Bacteroides cellulosilyticus | 840046 | 839324 |
| NZ_EQ973491.1 | Bacteroides cellulosilyticus | 390345 | 391469 |
| NZ_EQ973495.1 | Bacteroides cellulosilyticus | 334170 | 333598 |
| NZ_EQ973495.1 | Bacteroides cellulosilyticus | 227993 | 226980 |
| NZ_EQ973495.1 | Bacteroides cellulosilyticus | 344769 | 344113 |
| NZ_GG657591.1 | Clostridium asparagiforme | 931520 | 932323 |
| NZ_GG657591.1 | Clostridium asparagiforme | 935934 | 936779 |
| NZ_GG657595.1 | Clostridium asparagiforme | 537115 | 538233 |
| NZ_GG667607.1 | Hungatella hathewayi | 113320 | 112511 |
| NZ_GG667617.1 | Hungatella hathewayi | 14231 | 14869 |
| NZ_GG667628.1 | Hungatella hathewayi | 38593 | 38027 |
| NZ_GG688320.1 | Bacteroides finegoldii | 267192 | 266188 |
| NZ_GG688320.1 | Bacteroides finegoldii | 173035 | 171950 |
| NZ_GG688323.1 | Bacteroides finegoldii | 83014 | 84108 |
| NZ_GG692716.1 | Roseburia intestinalis | 72286 | 72888 |
| NZ_GG692716.1 | Roseburia intestinalis | 71753 | 72295 |
| NZ_GG703852.1 | Prevotella copri | 90990 | 89896 |
| NZ_GG704863.1 | Enterobacter cancerogenus | 1562280 | 1561468 |
| NZ_JH724294.1 | Bacteroides xylanisolvens | 1862842 | 1861706 |
| NZ_JH724294.1 | Bacteroides xylanisolvens | 388065 | 389069 |
| NZ_JH724295.1 | Bacteroides xylanisolvens | 302144 | 301509 |
| NZ_JH724295.1 | Bacteroides xylanisolvens | 278743 | 278141 |
| NZ_PUEL01000004.1 | Ruminococcus gnavus | 2996334 | 2997416 |
| NZ_PUEL01000004.1 | Ruminococcus gnavus | 1640981 | 1640310 |
| NZ_PUEM01000006.1 | Clostridium bolteae | 1701794 | 1700622 |
| NZ_PUEM01000006.1 | Clostridium bolteae | 3657608 | 3658609 |
| NZ_PUEM01000006.1 | Clostridium bolteae | 4021074 | 4021712 |
| NZ_PUEO01000014.1 | Bacteroides thetaiotaomicron | 3061847 | 3062941 |
| NZ_PUEO01000014.1 | Bacteroides thetaiotaomicron | 897383 | 898387 |
| NZ_PUEO01000014.1 | Bacteroides thetaiotaomicron | 1024402 | 1025283 |
| NZ_PUEP01000005.1 | Bacteroides ovatus | 1564102 | 1565238 |
| NZ_PUEP01000005.1 | Bacteroides ovatus | 3146595 | 3145591 |
| NZ_PUEP01000005.1 | Bacteroides ovatus | 2985753 | 2984668 |
| NZ_PUEP01000005.1 | Bacteroides ovatus | 5075403 | 5076038 |
| NZ_PUEP01000005.1 | Bacteroides ovatus | 3023635 | 3022754 |
| NZ_PUEP01000005.1 | Bacteroides ovatus | 5098803 | 5099405 |
| NZ_PUEQ01000003.1 | Bacteroides caccae | 2519904 | 2518900 |
| BACDOR_03379 | | 104 | 279 |
| BACDOR_03642 | | 343 | 492 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| BT_0445 | | 202 | 292 |
| BT_2961 | | 108 | 281 |
| CVOZ01000011.1 | Bacteroides thetaiotaomicron | 76510 | 77013 |
| NC_012781.1 | Eubacterium rectale | 1183363 | 1183959 |
| NZ_AAVN02000002.1 | Collinsella aerofaciens | 330907 | 330182 |
| NZ_DS996456.1 | Parabacteroides johnsonii | 448969 | 448454 |
| NZ_DS996921.1 | Bacteroides pectinophilus | 215363 | 215845 |
| NZ_JH724300.1 | Bacteroides xylanisolvens | 14445 | 13921 |
| NZ_AAVN02000002.1 | Collinsella aerofaciens | 331231 | 331860 |
| NZ_DS996921.1 | Bacteroides pectinophilus | 2180486 | 2181052 |
| CVOZ01000033.1 | Bacteroides thetaiotaomicron | 39992 | 39123 |
| CVOZ01000033.1 | Bacteroides thetaiotaomicron | 38164 | 37274 |
| JGCP01001040.1 | Bacteroides fragilis | 1038 | 415 |
| JGCP01001049.1 | Bacteroides fragilis | 113 | 619 |
| JGCP01001118.1 | Bacteroides fragilis | 510 | 25 |
| NC_000913.3 | Escherichia coli | 806660 | 806118 |
| NC_009614.1 | Bacteroides vulgatus | 2317377 | 2318246 |
| NC_009614.1 | Bacteroides vulgatus | 2352958 | 2353836 |
| NZ_AAVM02000003.1 | Bacteroides caccae | 186200 | 186913 |
| NZ_AAVM02000003.1 | Bacteroides caccae | 188146 | 189024 |
| NZ_AAVN02000002.1 | Collinsella aerofaciens | 333085 | 331844 |
| NZ_ABJL02000008.1 | Bacteroides intestinalis | 2827911 | 2827084 |
| NZ_ABJL02000008.1 | Bacteroides intestinalis | 2825593 | 2824715 |
| NZ_ABJL02000008.1 | Bacteroides intestinalis | 2763149 | 2762139 |
| NZ_ATFI01000004.1 | Bacteroides cellulosilyticus | 194890 | 194012 |
| NZ_ATFI01000004.1 | Bacteroides cellulosilyticus | 192550 | 191672 |
| NZ_ATFI01000004.1 | Bacteroides cellulosilyticus | 116394 | 115324 |
| NZ_CVOY01000004.1 | Bacteroides thetaiotaomicron | 32407 | 33276 |
| NZ_CVOY01000004.1 | Bacteroides thetaiotaomicron | 34236 | 35126 |
| NZ_DS264581.1 | Bacteroides ovatus | 361113 | 361889 |
| NZ_DS264581.1 | Bacteroides ovatus | 372065 | 372856 |
| NZ_DS264584.1 | Bacteroides ovatus | 300282 | 301151 |
| NZ_DS264584.1 | Bacteroides ovatus | 302363 | 303262 |
| NZ_DS264584.1 | Bacteroides ovatus | 314236 | 313235 |
| NZ_DS480674.1 | Clostridium bolteae | 63437 | 62442 |
| NZ_DS499676.1 | Bacteroides stercoris | 560446 | 559568 |
| NZ_DS499676.1 | Bacteroides stercoris | 562585 | 561713 |
| NZ_DS499676.1 | Bacteroides stercoris | 526258 | 525236 |
| NZ_DS990238.1 | Bifidobacterium longum | 757614 | 756904 |
| NZ_DS995509.1 | Bacteroides eggerthii | 326173 | 327018 |
| NZ_DS995509.1 | Bacteroides eggerthii | 328317 | 329195 |
| NZ_DS995536.1 | Bacteroides dorei | 285685 | 284816 |
| NZ_DS995536.1 | Bacteroides dorei | 241608 | 240730 |
| NZ_DS996923.1 | Bacteroides pectinophilus | 73704 | 72955 |
| NZ_EQ973491.1 | Bacteroides cellulosilyticus | 391606 | 392484 |
| NZ_EQ973491.1 | Bacteroides cellulosilyticus | 393946 | 394824 |
| NZ_EQ973491.1 | Bacteroides cellulosilyticus | 464286 | 465356 |
| NZ_GG688320.1 | Bacteroides finegoldii | 266145 | 265276 |
| NZ_GG688320.1 | Bacteroides finegoldii | 264126 | 263248 |
| NZ_GG688320.1 | Bacteroides finegoldii | 254019 | 255143 |
| NZ_GG688326.1 | Bacteroides finegoldii | 33875 | 33099 |
| NZ_GG688326.1 | Bacteroides finegoldii | 22923 | 22132 |
| NZ_GG692728.1 | Roseburia intestinalis | 82828 | 83886 |
| NZ_GG703853.1 | Prevotella copri | 101373 | 100462 |
| NZ_GG704864.1 | Enterobacter cancerogenus | 507462 | 506914 |
| NZ_JH724294.1 | Bacteroides xylanisolvens | 389193 | 390062 |
| NZ_JH724294.1 | Bacteroides xylanisolvens | 391274 | 392140 |
| NZ_JH724295.1 | Bacteroides xylanisolvens | 1554618 | 1555394 |
| NZ_JH724295.1 | Bacteroides xylanisolvens | 1565570 | 1566361 |
| NZ_PUEM01000006.1 | Clostridium bolteae | 5178002 | 5177007 |
| NZ_PUEO01000014.1 | Bacteroides thetaiotaomicron | 898508 | 899377 |
| NZ_PUEO01000014.1 | Bacteroides thetaiotaomicron | 900337 | 901227 |
| NZ_PUEP01000005.1 | Bacteroides ovatus | 3145467 | 3144598 |
| NZ_PUEP01000005.1 | Bacteroides ovatus | 3143386 | 3142487 |
| NZ_PUEP01000005.1 | Bacteroides ovatus | 3789254 | 3788478 |
| NZ_PUEP01000005.1 | Bacteroides ovatus | 3778302 | 3777511 |
| NZ_PUEP01000005.1 | Bacteroides ovatus | 3131513 | 3132514 |
| NZ_PUEQ01000003.1 | Bacteroides caccae | 2518776 | 2517907 |
| NZ_PUEQ01000003.1 | Bacteroides caccae | 2516829 | 2515951 |
| BACDOR_00571 | | 1 | 57 |
| BACDOR_03988 | | 41 | 155 |
| BT_1006 | | 1 | 62 |
| BT_1148 | | 5 | 170 |
| CVOZ01000044.1 | Bacteroides thetaiotaomicron | 270178 | 270675 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| CVOZ01000063.1 | *Bacteroides thetaiotaomicron* | 213252 | 213776 |
| JGCP01002451.1 | *Bacteroides fragilis* | 27278 | 27826 |
| JGCP01002532.1 | *Bacteroides fragilis* | 1990 | 1631 |
| NC_009614.1 | *Bacteroides vulgatus* | 2553345 | 2553821 |
| NC_009614.1 | *Bacteroides vulgatus* | 1289396 | 1288902 |
| NC_009614.1 | *Bacteroides vulgatus* | 3238578 | 3238234 |
| NC_009615.1 | *Parabacteroides distasonis* | 2044483 | 2044857 |
| NC_012781.1 | *Eubacterium rectale* | 1600354 | 1600857 |
| NZ_AAVM02000001.1 | *Bacteroides caccae* | 1119727 | 1119179 |
| NZ_AAVN02000007.1 | *Collinsella aerofaciens* | 43328 | 42810 |
| NZ_AAXA02000015.1 | *Dorea formicigenerans* | 428152 | 428658 |
| NZ_AAXA02000015.1 | *Dorea formicigenerans* | 812485 | 812937 |
| NZ_AAYG02000005.1 | *Ruminococcus gnavus* | 169559 | 170014 |
| NZ_ABJL02000007.1 | *Bacteroides intestinalis* | 959642 | 959145 |
| NZ_ABJL02000008.1 | *Bacteroides intestinalis* | 574710 | 574237 |
| NZ_ABXA01000037.1 | *Anaerococcus hydrogenalis* | 15300 | 14881 |
| NZ_ACCL02000007.1 | *Marvinbryantia formatexigens* | 30299 | 30799 |
| NZ_ACEP01000002.1 | *Eubacterium hallii* | 34255 | 34773 |
| NZ_ATFI01000001.1 | *Bacteroides cellulosilyticus* | 1579899 | 1579402 |
| NZ_ATFI01000012.1 | *Bacteroides cellulosilyticus* | 48936 | 48463 |
| NZ_CVOY01000042.1 | *Bacteroides thetaiotaomicron* | 62958 | 62434 |
| NZ_CVOY01000048.1 | *Bacteroides thetaiotaomicron* | 31368 | 31865 |
| NZ_DS264270.1 | *Eubacterium ventriosum* | 212238 | 212747 |
| NZ_DS264542.1 | *Parabacteroides merdae* | 249192 | 248833 |
| NZ_DS264582.1 | *Bacteroides ovatus* | 368681 | 369235 |
| NZ_DS362244.1 | *Bacteroides uniformis* | 170469 | 171023 |
| NZ_DS362248.1 | *Bacteroides uniformis* | 308163 | 308660 |
| NZ_DS480690.1 | *Clostridium bolteae* | 244844 | 244341 |
| NZ_DS480692.1 | *Clostridium bolteae* | 142185 | 141841 |
| NZ_DS499659.1 | *Erysipelatoclostridium ramosum* | 548774 | 548271 |
| NZ_DS499672.1 | *Bacteroides stercoris* | 113154 | 113663 |
| NZ_DS499674.1 | *Bacteroides stercoris* | 145536 | 146033 |
| NZ_DS499701.1 | *Clostridium scindens* | 43478 | 43023 |
| NZ_DS544193.1 | *Anaerotruncus colihominis* | 200258 | 200770 |
| NZ_DS562846.1 | *Clostridium spiroforme* | 146418 | 145852 |
| NZ_DS981517.1 | *Clostridium sporogenes* | 2367346 | 2367882 |
| NZ_DS981518.1 | *Clostridium sporogenes* | 524044 | 524544 |
| NZ_DS990201.1 | *Ruminococcus lactaris* | 50105 | 50611 |
| NZ_DS995510.1 | *Bacteroides eggerthii* | 730877 | 731395 |
| NZ_DS995511.1 | *Bacteroides eggerthii* | 244997 | 245494 |
| NZ_DS995534.1 | *Bacteroides dorei* | 71640 | 71146 |
| NZ_DS995536.1 | *Bacteroides dorei* | 38622 | 38146 |
| NZ_DS995537.1 | *Bacteroides dorei* | 674814 | 674470 |
| NZ_DS996446.1 | *Parabacteroides johnsonii* | 59119 | 59580 |
| NZ_DS996841.1 | *Holdemanella biformis* | 240823 | 240320 |
| NZ_DS996844.1 | *Holdemanella biformis* | 9201 | 9716 |
| NZ_DS996847.1 | *Holdemanella biformis* | 35952 | 36299 |
| NZ_DS996921.1 | *Bacteroides pectinophilus* | 1377570 | 1378040 |
| NZ_EQ973490.1 | *Bacteroides cellulosilyticus* | 1771262 | 1770765 |
| NZ_EQ973492.1 | *Bacteroides cellulosilyticus* | 269763 | 270236 |
| NZ_EQ973631.1 | *Bacteroides coprophilus* | 166069 | 166566 |
| NZ_EQ973635.1 | *Bacteroides coprophilus* | 157971 | 157465 |
| NZ_EQ973650.1 | *Bacteroides coprophilus* | 309678 | 310139 |
| NZ_EQ973651.1 | *Bacteroides coprophilus* | 186918 | 186481 |
| NZ_GG657587.1 | *Clostridium asparagiforme* | 626172 | 625822 |
| NZ_GG657592.1 | *Clostridium asparagiforme* | 256639 | 256139 |
| NZ_GG657592.1 | *Clostridium asparagiforme* | 2004022 | 2003468 |
| NZ_GG662014.1 | *Coprococcus comes* | 263241 | 263747 |
| NZ_GG662014.1 | *Coprococcus comes* | 272780 | 273106 |
| NZ_GG688323.1 | *Bacteroides finegoldii* | 185574 | 185020 |
| NZ_GG688343.1 | *Bacteroides finegoldii* | 10025 | 9510 |
| NZ_GG692710.1 | *Collinsella intestinalis* | 212696 | 213166 |
| NZ_GG692721.1 | *Roseburia intestinalis* | 15573 | 16079 |
| NZ_GG698591.1 | *Blautia hansenii* | 291863 | 291519 |
| NZ_GG703859.1 | *Prevotella copri* | 138307 | 138801 |
| NZ_GG704769.1 | *Subdoligranulum variabile* | 1245783 | 1245277 |
| NZ_GG704774.1 | *Subdoligranulum variabile* | 1821 | 2216 |
| NZ_JGDE01000083.1 | *Bacteroides fragilis* | 52785 | 53333 |
| NZ_JGDE01000126.1 | *Bacteroides fragilis* | 19699 | 19340 |
| NZ_JH370371.1 | *Alistipes indistinctus* | 1289779 | 1289264 |
| NZ_JH724294.1 | *Bacteroides xylanisolvens* | 1743283 | 1743837 |
| NZ_KE993038.1 | *Clostridium symbiosum* | 28571 | 29017 |
| NZ_MTWC01000003.1 | *Clostridioides difficile* | 851741 | 852091 |
| NZ_MTWC01000003.1 | *Clostridioides difficile* | 764221 | 764625 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_MTWC01000003.1 | Clostridioides difficile | 3694907 | 3694437 |
| NZ_MTWD01000001.1 | Clostridioides difficile | 951757 | 952107 |
| NZ_MTWD01000001.1 | Clostridioides difficile | 864279 | 864683 |
| NZ_MTWD01000001.1 | Clostridioides difficile | 3699874 | 3699404 |
| NZ_MTWE01000004.1 | Clostridioides difficile | 3086150 | 3086656 |
| NZ_MTWE01000004.1 | Clostridioides difficile | 644554 | 644913 |
| NZ_MTWE01000004.1 | Clostridioides difficile | 562111 | 562515 |
| NZ_MTWE01000004.1 | Clostridioides difficile | 3362803 | 3362396 |
| NZ_MTWF01000010.1 | Clostridioides difficile | 538758 | 539108 |
| NZ_MTWF01000010.1 | Clostridioides difficile | 451169 | 451573 |
| NZ_MTWF01000021.1 | Clostridioides difficile | 734579 | 734109 |
| NZ_PPUH01000002.1 | Eggerthella lenta | 235541 | 236044 |
| NZ_PUEL01000004.1 | Ruminococcus gnavus | 215261 | 214806 |
| NZ_PUEM01000006.1 | Clostridium bolteae | 4914472 | 4913969 |
| NZ_PUEM01000006.1 | Clostridium bolteae | 4326890 | 4327234 |
| NZ_PUEO01000014.1 | Bacteroides thetaiotaomicron | 3235791 | 3235294 |
| NZ_PUEP01000005.1 | Bacteroides ovatus | 1680428 | 1679874 |
| NZ_PUEQ01000003.1 | Bacteroides caccae | 1408538 | 1407990 |
| NZ_UFTH01000001.1 | Bacteroides fragilis | 4377477 | 4378025 |
| NZ_UFTH01000001.1 | Bacteroides fragilis | 627443 | 627084 |
| NZ_UFTH01000002.1 | Bacteroides fragilis | 31675 | 32046 |
| JGCP01000859.1 | Bacteroides fragilis | 247 | 660 |
| JGCP01002352.1 | Bacteroides fragilis | 14649 | 15062 |
| NC_000913.3 | Escherichia coli | 3231665 | 3233218 |
| NC_008618.1 | Bifidobacterium adolescentis | 1689422 | 1688412 |
| NC_009614.1 | Bacteroides vulgatus | 1477586 | 1477173 |
| NC_012781.1 | Eubacterium rectale | 2728515 | 2729615 |
| NZ_AAVM02000002.1 | Bacteroides caccae | 251699 | 252112 |
| NZ_AAVN02000002.1 | Collinsella aerofaciens | 326185 | 324458 |
| NZ_AAVN02000008.1 | Collinsella aerofaciens | 49145 | 47112 |
| NZ_AAYG02000005.1 | Ruminococcus gnavus | 53408 | 52044 |
| NZ_AAYG02000005.1 | Ruminococcus gnavus | 53906 | 53610 |
| NZ_AAYG02000018.1 | Ruminococcus gnavus | 115281 | 114544 |
| NZ_AAYG02000018.1 | Ruminococcus gnavus | 114545 | 113859 |
| NZ_AAYG02000020.1 | Ruminococcus gnavus | 33742 | 31967 |
| NZ_ABXW01000007.1 | Providencia alcalifaciens | 83384 | 82374 |
| NZ_ABXW01000014.1 | Providencia alcalifaciens | 201354 | 200305 |
| NZ_ABXW01000019.1 | Providencia alcalifaciens | 39201 | 39665 |
| NZ_ABXW01000047.1 | Providencia alcalifaciens | 151003 | 149450 |
| NZ_ACCL02000002.1 | Marvinbryantia formatexigens | 238233 | 239315 |
| NZ_ACEP01000036.1 | Eubacterium hallii | 20427 | 18634 |
| NZ_ACEP01000036.1 | Eubacterium hallii | 6263 | 6859 |
| NZ_ACEP01000054.1 | Eubacterium hallii | 38370 | 37309 |
| NZ_AHVA01000007.1 | Salmonella enterica | 585091 | 586644 |
| NZ_DS264365.1 | Ruminococcus torques | 38444 | 36861 |
| NZ_DS264366.1 | Ruminococcus torques | 14189 | 12285 |
| NZ_DS264366.1 | Ruminococcus torques | 12251 | 10338 |
| NZ_DS264374.1 | Ruminococcus torques | 22043 | 20577 |
| NZ_DS264376.1 | Ruminococcus torques | 81045 | 82469 |
| NZ_DS264579.1 | Bacteroides ovatus | 391612 | 392025 |
| NZ_DS480725.1 | Clostridium bolteae | 73291 | 75168 |
| NZ_DS499653.1 | Erysipelatoclostridium ramosum | 163876 | 161984 |
| NZ_DS499655.1 | Erysipelatoclostridium ramosum | 92494 | 94494 |
| NZ_DS499659.1 | Erysipelatoclostridium ramosum | 820298 | 822214 |
| NZ_DS499659.1 | Erysipelatoclostridium ramosum | 187711 | 189624 |
| NZ_DS499659.1 | Erysipelatoclostridium ramosum | 830720 | 828918 |
| NZ_DS499659.1 | Erysipelatoclostridium ramosum | 818839 | 819687 |
| NZ_DS499659.1 | Erysipelatoclostridium ramosum | 811198 | 809723 |
| NZ_DS499659.1 | Erysipelatoclostridium ramosum | 818320 | 818655 |
| NZ_DS499674.1 | Bacteroides stercoris | 281199 | 280756 |
| NZ_DS499678.1 | Clostridium scindens | 34299 | 33472 |
| NZ_DS499684.1 | Clostridium scindens | 29932 | 31860 |
| NZ_DS499697.1 | Clostridium scindens | 295175 | 293268 |
| NZ_DS499710.1 | Clostridium scindens | 88907 | 87510 |
| NZ_DS499710.1 | Clostridium scindens | 82861 | 81515 |
| NZ_DS499710.1 | Clostridium scindens | 83371 | 83048 |
| NZ_DS499710.1 | Clostridium scindens | 89399 | 89103 |
| NZ_DS607663.1 | Providencia stuartii | 624169 | 623150 |
| NZ_DS607678.1 | Providencia stuartii | 131768 | 133240 |
| NZ_DS981517.1 | Clostridium sporogenes | 1504597 | 1506570 |
| NZ_DS990176.1 | Ruminococcus lactaris | 30347 | 30943 |
| NZ_DS990176.1 | Ruminococcus lactaris | 29846 | 30169 |
| NZ_DS990190.1 | Ruminococcus lactaris | 3899 | 2472 |
| NZ_DS990238.1 | Bifidobacterium longum | 255030 | 254731 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_DS990238.1 | Bifidobacterium longum | 255196 | 255005 |
| NZ_DS995534.1 | Bacteroides dorei | 335106 | 334693 |
| NZ_DS996444.1 | Parabacteroides johnsonii | 867248 | 867835 |
| NZ_DS996841.1 | Holdemanella biformis | 213342 | 211348 |
| NZ_DS996841.1 | Holdemanella biformis | 215261 | 213360 |
| NZ_DS996841.1 | Holdemanella biformis | 167745 | 166951 |
| NZ_DS996841.1 | Holdemanella biformis | 168255 | 167947 |
| NZ_DS996842.1 | Holdemanella biformis | 294507 | 293134 |
| NZ_DS996844.1 | Holdemanella biformis | 11340 | 9940 |
| NZ_GG657591.1 | Clostridium asparagiforme | 187173 | 186097 |
| NZ_GG657592.1 | Clostridium asparagiforme | 3032918 | 3034684 |
| NZ_GG657592.1 | Clostridium asparagiforme | 1876564 | 1874570 |
| NZ_GG657592.1 | Clostridium asparagiforme | 3069663 | 3067939 |
| NZ_GG657592.1 | Clostridium asparagiforme | 2542323 | 2540860 |
| NZ_GG661994.1 | Proteus penneri | 222623 | 221616 |
| NZ_GG661996.1 | Proteus penneri | 924601 | 925488 |
| NZ_GG661996.1 | Proteus penneri | 924431 | 924589 |
| NZ_GG661996.1 | Proteus penneri | 923938 | 924240 |
| NZ_GG662014.1 | Coprococcus comes | 645523 | 644906 |
| NZ_GG662014.1 | Coprococcus comes | 646024 | 645701 |
| NZ_GG667620.1 | Hungatella hathewayi | 7252 | 6188 |
| NZ_GG667622.1 | Hungatella hathewayi | 37613 | 39523 |
| NZ_GG667690.1 | Hungatella hathewayi | 16181 | 14763 |
| NZ_GG667690.1 | Hungatella hathewayi | 14690 | 13062 |
| NZ_GG667690.1 | Hungatella hathewayi | 16682 | 16383 |
| NZ_GG688332.1 | Bacteroides finegoldii | 98265 | 98678 |
| NZ_GG692710.1 | Collinsella intestinalis | 1185313 | 1183391 |
| NZ_GG692717.1 | Roseburia intestinalis | 224174 | 223578 |
| NZ_GG692717.1 | Roseburia intestinalis | 224675 | 224352 |
| NZ_GG692736.1 | Roseburia intestinalis | 17269 | 15341 |
| NZ_GG704769.1 | Subdoligranulum variabile | 78938 | 80308 |
| NZ_GG704769.1 | Subdoligranulum variabile | 2209221 | 2208253 |
| NZ_GG704771.1 | Subdoligranulum variabile | 256941 | 258851 |
| NZ_GG704865.1 | Enterobacter cancerogenus | 770824 | 771876 |
| NZ_GG704865.1 | Enterobacter cancerogenus | 770338 | 770634 |
| NZ_GG705262.1 | Providencia rettgeri | 1574659 | 1576197 |
| NZ_GG705262.1 | Providencia rettgeri | 701537 | 702553 |
| NZ_GG705263.1 | Providencia rettgeri | 326238 | 325780 |
| NZ_GG729830.1 | Bifidobacterium breve | 608625 | 609662 |
| NZ_GG739633.1 | Edwardsiella tarda | 1475528 | 1475019 |
| NZ_JGDE01000165.1 | Bacteroides fragilis | 75469 | 75882 |
| NZ_JH724295.1 | Bacteroides xylanisolvens | 710795 | 711208 |
| NZ_KE992800.1 | Clostridium symbiosum | 26653 | 24728 |
| NZ_KE992800.1 | Clostridium symbiosum | 28977 | 30416 |
| NZ_MTWC01000003.1 | Clostridioides difficile | 3079200 | 3078121 |
| NZ_MTWC01000003.1 | Clostridioides difficile | 2889511 | 2888225 |
| NZ_MTWC01000003.1 | Clostridioides difficile | 2890009 | 2889704 |
| NZ_MTWD01000001.1 | Clostridioides difficile | 3091419 | 3090340 |
| NZ_MTWD01000001.1 | Clostridioides difficile | 2930504 | 2929218 |
| NZ_MTWD01000001.1 | Clostridioides difficile | 2931002 | 2930697 |
| NZ_MTWE01000004.1 | Clostridioides difficile | 3102040 | 3100103 |
| NZ_MTWE01000004.1 | Clostridioides difficile | 2802748 | 2801669 |
| NZ_MTWE01000004.1 | Clostridioides difficile | 2648868 | 2647582 |
| NZ_MTWE01000004.1 | Clostridioides difficile | 2649366 | 2649061 |
| NZ_MTWF01000021.1 | Clostridioides difficile | 150497 | 149418 |
| NZ_PPUH01000004.1 | Eggerthella lenta | 75047 | 76951 |
| NZ_PPUH01000004.1 | Eggerthella lenta | 77693 | 78493 |
| NZ_PPUH01000004.1 | Eggerthella lenta | 174728 | 175240 |
| NZ_PUEL01000004.1 | Ruminococcus gnavus | 2242708 | 2240789 |
| NZ_PUEL01000004.1 | Ruminococcus gnavus | 820113 | 822041 |
| NZ_PUEL01000004.1 | Ruminococcus gnavus | 1519478 | 1517703 |
| NZ_PUEL01000004.1 | Ruminococcus gnavus | 331413 | 332777 |
| NZ_PUEL01000004.1 | Ruminococcus gnavus | 657923 | 656505 |
| NZ_PUEL01000004.1 | Ruminococcus gnavus | 2201457 | 2200561 |
| NZ_PUEL01000004.1 | Ruminococcus gnavus | 330915 | 331211 |
| NZ_PUEM01000006.1 | Clostridium bolteae | 2793257 | 2795134 |
| NZ_PUEO01000004.1 | Bacteroides thetaiotaomicron | 1043585 | 1044007 |
| NZ_PUEP01000005.1 | Bacteroides ovatus | 4630286 | 4629873 |
| NZ_PUEQ01000003.1 | Bacteroides caccae | 3370211 | 3369798 |
| NZ_UFTH01000001.1 | Bacteroides fragilis | 1975000 | 1975413 |
| QEKH01000021.1 | Victivallis vadensis | 49835 | 50419 |
| BACDOR_03937 | | 52 | 92 |
| BT_1192 | | 37 | 160 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| CVOZ01000002.1 | *Bacteroides thetaiotaomicron* | 27472 | 28101 |
| CVOZ01000011.1 | *Bacteroides thetaiotaomicron* | 27140 | 27421 |
| NC_000913.3 | *Escherichia coli* | 499727 | 499083 |
| NC_012781.1 | *Eubacterium rectale* | 2291176 | 2290535 |
| NZ_AAVN02000008.1 | *Collinsella aerofaciens* | 95394 | 94330 |
| NZ_AAXA02000008.1 | *Dorea formicigenerans* | 69701 | 70546 |
| NZ_AAXA02000008.1 | *Dorea formicigenerans* | 71748 | 72386 |
| NZ_AAXA02000009.1 | *Dorea formicigenerans* | 62902 | 62264 |
| NZ_AAYG02000031.1 | *Ruminococcus gnavus* | 40641 | 39991 |
| NZ_ABXWO1000046.1 | *Providencia alcalifaciens* | 144717 | 144040 |
| NZ_ACCL02000001.1 | *Marvinbryantia formatexigens* | 132276 | 132626 |
| NZ_ATFI01000001.1 | *Bacteroides cellulosilyticus* | 965679 | 965404 |
| NZ_DS264269.1 | *Eubacterium ventriosum* | 21943 | 23007 |
| NZ_DS264517.1 | *Parabacteroides merdae* | 22275 | 22898 |
| NZ_DS480686.1 | *Clostridium bolteae* | 99911 | 99264 |
| NZ_DS499709.1 | *Clostridium scindens* | 27922 | 27179 |
| NZ_DS544180.1 | *Anaerotruncus colihominis* | 47523 | 48269 |
| NZ_DS981517.1 | *Clostridium sporogenes* | 1498487 | 1499116 |
| NZ_DS990176.1 | *Ruminococcus lactaris* | 24402 | 24085 |
| NZ_DS996453.1 | *Parabacteroides johnsonii* | 2536 | 1919 |
| NZ_DS996921.1 | *Bacteroides pectinophilus* | 1518411 | 1519052 |
| NZ_EQ973490.1 | *Bacteroides cellulosilyticus* | 1170390 | 1170115 |
| NZ_GG657590.1 | *Clostridium asparagiforme* | 216404 | 215709 |
| NZ_GG657591.1 | *Clostridium asparagiforme* | 525486 | 524806 |
| NZ_GG657592.1 | *Clostridium asparagiforme* | 1824491 | 1824808 |
| NZ_GG657592.1 | *Clostridium asparagiforme* | 958061 | 957219 |
| NZ_GG657592.1 | *Clostridium asparagiforme* | 1368813 | 1368559 |
| NZ_GG657595.1 | *Clostridium asparagiforme* | 413311 | 412655 |
| NZ_GG661997.1 | *Proteus penneri* | 158305 | 158997 |
| NZ_GG662010.1 | *Coprococcus comes* | 133481 | 132858 |
| NZ_GG667612.1 | *Hungatella hathewayi* | 83476 | 84156 |
| NZ_GG667653.1 | *Hungatella hathewayi* | 9768 | 10541 |
| NZ_GG667663.1 | *Hungatella hathewayi* | 28932 | 29255 |
| NZ_GG688324.1 | *Bacteroides finegoldii* | 191844 | 191179 |
| NZ_GG692718.1 | *Roseburia intestinalis* | 13388 | 12747 |
| NZ_GG692729.1 | *Roseburia intestinalis* | 23802 | 23545 |
| NZ_GG703854.1 | *Prevotella copri* | 344197 | 344454 |
| NZ_GG703864.1 | *Prevotella copri* | 76937 | 77305 |
| NZ_GG704769.1 | *Subdoligranulum variabile* | 569661 | 570269 |
| NZ_GG704770.1 | *Subdoligranulum variabile* | 279973 | 280239 |
| NZ_GG704867.1 | *Enterobacter cancerogenus* | 32796 | 32065 |
| NZ_GG705262.1 | *Providencia rettgeri* | 737987 | 738844 |
| NZ_GG739633.1 | *Edwardsiella tarda* | 2215417 | 2214740 |
| NZ_KE992946.1 | *Clostridium symbiosum* | 16142 | 16942 |
| NZ_PUEL01000004.1 | *Ruminococcus gnavus* | 1068338 | 1067598 |
| NZ_PUEM01000006.1 | *Clostridium bolteae* | 3409802 | 3410449 |
| NZ_PUEO01000004.1 | *Bacteroides thetaiotaomicron* | 909868 | 909239 |
| QEKH01000003.1 | *Victivallis vadensis* | 74432 | 75064 |
| QEKH01000014.1 | *Victivallis vadensis* | 38351 | 38740 |
| QEKH01000019.1 | *Victivallis vadensis* | 58559 | 57939 |
| NC_012781.1 | *Eubacterium rectale* | 3213966 | 3213511 |
| NC_012781.1 | *Eubacterium rectale* | 3389503 | 3389354 |
| NZ_AAVN02000015.1 | *Collinsella aerofaciens* | 28383 | 27748 |
| NZ_DS996455.1 | *Parabacteroides johnsonii* | 38505 | 38065 |
| NZ_DS996923.1 | *Bacteroides pectinophilus* | 151384 | 150950 |
| NZ_GG662014.1 | *Coprococcus comes* | 572680 | 573108 |
| NZ_GG692710.1 | *Collinsella intestinalis* | 1019799 | 1020606 |
| NZ_GG704769.1 | *Subdoligranulum variabile* | 1665742 | 1666170 |
| NZ_MTWE01000004.1 | *Clostridioides difficile* | 130482 | 130892 |
| NZ_DS499679.1 | *Clostridium scindens* | 6626 | 6823 |
| NZ_DS499680.1 | *Clostridium scindens* | 39909 | 40277 |
| NZ_DS499698.1 | *Clostridium scindens* | 86368 | 86784 |
| NZ_GG692724.1 | *Roseburia intestinalis* | 114328 | 114747 |
| NZ_GG692735.1 | *Roseburia intestinalis* | 3089 | 3505 |
| NZ_GG692775.1 | *Roseburia intestinalis* | 9058 | 9255 |
| NZ_GG692775.1 | *Roseburia intestinalis* | 9246 | 9338 |
| NZ_GG692783.1 | *Roseburia intestinalis* | 258 | 347 |
| NZ_DS264270.1 | *Eubacterium ventriosum* | 117297 | 117686 |
| NZ_DS264270.1 | *Eubacterium ventriosum* | 117008 | 117298 |
| NZ_DS499698.1 | *Clostridium scindens* | 87519 | 86782 |
| NZ_DS499700.1 | *Clostridium scindens* | 21096 | 20401 |
| NZ_GG662007.1 | *Coprococcus comes* | 543307 | 543696 |
| NZ_GG662007.1 | *Coprococcus comes* | 543102 | 543311 |
| NZ_GG703852.1 | *Prevotella copri* | 145367 | 145672 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_GG703860.1 | Prevotella copri | 53657 | 53133 |
| NZ_GG703860.1 | Prevotella copri | 54778 | 54395 |
| NC_008618.1 | Bifidobacterium adolescentis | 964374 | 964060 |
| NC_012781.1 | Eubacterium rectale | 992985 | 993416 |
| NC_012781.1 | Eubacterium rectale | 1393674 | 1394102 |
| NZ_AAVN02000001.1 | Collinsella aerofaciens | 457597 | 458028 |
| NZ_AAVN02000002.1 | Collinsella aerofaciens | 91743 | 90853 |
| NZ_AAXA02000006.1 | Dorea formicigenerans | 4930 | 4118 |
| NZ_AAXA02000007.1 | Dorea formicigenerans | 75838 | 76302 |
| NZ_AAXA02000012.1 | Dorea formicigenerans | 143739 | 143305 |
| NZ_AAXA02000014.1 | Dorea formicigenerans | 8125 | 8556 |
| NZ_AAXA02000014.1 | Dorea formicigenerans | 9822 | 10076 |
| NZ_AAXA02000015.1 | Dorea formicigenerans | 114251 | 113727 |
| NZ_AAXA02000016.1 | Dorea formicigenerans | 118699 | 118268 |
| NZ_ABXA01000032.1 | Anaerococcus hydrogenalis | 34181 | 34612 |
| NZ_ABXA01000043.1 | Anaerococcus hydrogenalis | 135344 | 135775 |
| NZ_ABXW01000049.1 | Providencia alcalifaciens | 145285 | 145707 |
| NZ_ACCL02000001.1 | Marvinbryantia formatexigens | 57072 | 56389 |
| NZ_ACCL02000014.1 | Marvinbryantia formatexigens | 117997 | 118428 |
| NZ_ACCL02000014.1 | Marvinbryantia formatexigens | 75359 | 75772 |
| NZ_ACCL02000033.1 | Marvinbryantia formatexigens | 13896 | 13381 |
| NZ_ACEP01000042.1 | Eubacterium hallii | 5704 | 5186 |
| NZ_ACEP01000171.1 | Eubacterium hallii | 13836 | 13606 |
| NZ_AHVA01000007.1 | Salmonella enterica | 612224 | 611889 |
| NZ_AHVA01000007.1 | Salmonella enterica | 380642 | 380214 |
| NZ_DS264265.1 | Eubacterium ventriosum | 210966 | 210535 |
| NZ_DS264270.1 | Eubacterium ventriosum | 218825 | 219256 |
| NZ_DS264344.1 | Ruminococcus torques | 61376 | 60936 |
| NZ_DS480671.1 | Clostridium bolteae | 257033 | 256143 |
| NZ_DS480671.1 | Clostridium bolteae | 83250 | 82915 |
| NZ_DS480680.1 | Clostridium bolteae | 299464 | 299204 |
| NZ_DS480690.1 | Clostridium bolteae | 111366 | 111980 |
| NZ_DS480694.1 | Clostridium bolteae | 234643 | 233795 |
| NZ_DS480694.1 | Clostridium bolteae | 405777 | 405625 |
| NZ_DS480694.1 | Clostridium bolteae | 311382 | 311744 |
| NZ_DS480694.1 | Clostridium bolteae | 371292 | 371077 |
| NZ_DS480723.1 | Clostridium bolteae | 101986 | 101747 |
| NZ_DS499654.1 | Erysipelatoclostridium ramosum | 170533 | 170264 |
| NZ_DS499654.1 | Erysipelatoclostridium ramosum | 200127 | 200339 |
| NZ_DS499655.1 | Erysipelatoclostridium ramosum | 450584 | 451015 |
| NZ_DS499655.1 | Erysipelatoclostridium ramosum | 542015 | 542440 |
| NZ_DS499656.1 | Erysipelatoclostridium ramosum | 185343 | 185780 |
| NZ_DS499660.1 | Erysipelatoclostridium ramosum | 11106 | 11321 |
| NZ_DS499680.1 | Clostridium scindens | 6317 | 6895 |
| NZ_DS499691.1 | Clostridium scindens | 857 | 36 |
| NZ_DS499694.1 | Clostridium scindens | 1192 | 683 |
| NZ_DS499698.1 | Clostridium scindens | 88546 | 87611 |
| NZ_DS499705.1 | Clostridium scindens | 87758 | 87324 |
| NZ_DS499710.1 | Clostridium scindens | 106171 | 105356 |
| NZ_DS499714.1 | Clostridium scindens | 7330 | 7908 |
| NZ_DS499718.1 | Clostridium scindens | 379001 | 378474 |
| NZ_DS544185.1 | Anaerotruncus colihominis | 244252 | 243629 |
| NZ_DS544185.1 | Anaerotruncus colihominis | 232765 | 232478 |
| NZ_DS544188.1 | Anaerotruncus colihominis | 264851 | 264282 |
| NZ_DS544193.1 | Anaerotruncus colihominis | 198228 | 198013 |
| NZ_DS562853.1 | Clostridium spiroforme | 198492 | 198923 |
| NZ_DS562853.1 | Clostridium spiroforme | 337920 | 338357 |
| NZ_DS607663.1 | Providencia stuartii | 885247 | 885516 |
| NZ_DS607670.1 | Providencia stuartii | 93145 | 93360 |
| NZ_DS981517.1 | Clostridium sporogenes | 2147870 | 2148421 |
| NZ_DS981518.1 | Clostridium sporogenes | 505394 | 504957 |
| NZ_DS981518.1 | Clostridium sporogenes | 896212 | 896361 |
| NZ_DS990163.1 | Ruminococcus lactaris | 69898 | 69683 |
| NZ_DS990202.1 | Ruminococcus lactaris | 150898 | 151329 |
| NZ_DS990239.1 | Bifidobacterium longum | 417566 | 416994 |
| NZ_DS996841.1 | Holdemanella biformis | 302699 | 303286 |
| NZ_DS996843.1 | Holdemanella biformis | 156961 | 157398 |
| NZ_DS996846.1 | Holdemanella biformis | 91009 | 90554 |
| NZ_DS996921.1 | Bacteroides pectinophilus | 1770364 | 1769933 |
| NZ_GG657587.1 | Clostridium asparagiforme | 197966 | 198217 |
| NZ_GG657587.1 | Clostridium asparagiforme | 484513 | 484328 |
| NZ_GG657587.1 | Clostridium asparagiforme | 462837 | 462550 |
| NZ_GG657587.1 | Clostridium asparagiforme | 568461 | 568700 |
| NZ_GG657589.1 | Clostridium asparagiforme | 86677 | 87105 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_GG657590.1 | Clostridium asparagiforme | 174026 | 174313 |
| NZ_GG657590.1 | Clostridium asparagiforme | 132367 | 131576 |
| NZ_GG657591.1 | Clostridium asparagiforme | 926075 | 926557 |
| NZ_GG657592.1 | Clostridium asparagiforme | 2125178 | 2125744 |
| NZ_GG657592.1 | Clostridium asparagiforme | 2150188 | 2149304 |
| NZ_GG657592.1 | Clostridium asparagiforme | 35707 | 35865 |
| NZ_GG657592.1 | Clostridium asparagiforme | 54324 | 54085 |
| NZ_GG657592.1 | Clostridium asparagiforme | 2149209 | 2148745 |
| NZ_GG657592.1 | Clostridium asparagiforme | 1241014 | 1241166 |
| NZ_GG657592.1 | Clostridium asparagiforme | 53378 | 53037 |
| NZ_GG657592.1 | Clostridium asparagiforme | 2939085 | 2939318 |
| NZ_GG657592.1 | Clostridium asparagiforme | 253538 | 253311 |
| NZ_GG657592.1 | Clostridium asparagiforme | 1931348 | 1931782 |
| NZ_GG657592.1 | Clostridium asparagiforme | 1199059 | 1198841 |
| NZ_GG657592.1 | Clostridium asparagiforme | 1304859 | 1305089 |
| NZ_GG657592.1 | Clostridium asparagiforme | 2964883 | 2964650 |
| NZ_GG657592.1 | Clostridium asparagiforme | 1583120 | 1583629 |
| NZ_GG657676.1 | Clostridium asparagiforme | 122 | 361 |
| NZ_GG662007.1 | Coprococcus comes | 232709 | 232482 |
| NZ_GG662010.1 | Coprococcus comes | 47027 | 46236 |
| NZ_GG662010.1 | Coprococcus comes | 147979 | 147725 |
| NZ_GG662012.1 | Coprococcus comes | 9623 | 10057 |
| NZ_GG662014.1 | Coprococcus comes | 261751 | 261320 |
| NZ_GG667610.1 | Hungatella hathewayi | 84423 | 83608 |
| NZ_GG667612.1 | Hungatella hathewayi | 35585 | 35040 |
| NZ_GG667612.1 | Hungatella hathewayi | 51608 | 51405 |
| NZ_GG667615.1 | Hungatella hathewayi | 61630 | 62061 |
| NZ_GG667627.1 | Hungatella hathewayi | 29759 | 30193 |
| NZ_GG667675.1 | Hungatella hathewayi | 6837 | 6418 |
| NZ_GG692710.1 | Collinsella intestinalis | 133099 | 132209 |
| NZ_GG692719.1 | Roseburia intestinalis | 139466 | 139038 |
| NZ_GG692742.1 | Roseburia intestinalis | 31102 | 30953 |
| NZ_GG698588.1 | Blautia hansenii | 886407 | 886556 |
| NZ_GG704770.1 | Subdoligranulum variabile | 299826 | 299407 |
| NZ_GG704865.1 | Enterobacter cancerogenus | 800444 | 800235 |
| NZ_GG705267.1 | Providencia rettgeri | 240910 | 241179 |
| NZ_GG729830.1 | Bifidobacterium breve | 1203629 | 1203057 |
| NZ_GG739633.1 | Edwardsiella tarda | 295285 | 296013 |
| NZ_GG739633.1 | Edwardsiella tarda | 756703 | 756912 |
| NZ_KB946519.1 | Enterococcus faecalis | 1294830 | 1294402 |
| NZ_KE136402.1 | Enterococcus faecalis | 1806226 | 1806654 |
| NZ_KE992790.1 | Clostridium symbiosum | 1050 | 787 |
| NZ_KE992799.1 | Clostridium symbiosum | 48485 | 48258 |
| NZ_KE992855.1 | Clostridium symbiosum | 65420 | 64728 |
| NZ_KE993024.1 | Clostridium symbiosum | 34019 | 34249 |
| NZ_MTWC01000003.1 | Clostridioides difficile | 1879743 | 1879994 |
| NZ_MTWD01000001.1 | Clostridioides difficile | 1922488 | 1922739 |
| NZ_MTWE01000004.1 | Clostridioides difficile | 1625560 | 1625811 |
| NZ_MTWE01000004.1 | Clostridioides difficile | 3637126 | 3636857 |
| NZ_PUEL01000004.1 | Ruminococcus gnavus | 2325881 | 2326312 |
| NZ_PUEM01000006.1 | Clostridium bolteae | 5802124 | 5802972 |
| NZ_PUEM01000006.1 | Clostridium bolteae | 2707890 | 2708324 |
| NZ_PUEM01000006.1 | Clostridium bolteae | 3193896 | 3193006 |
| NZ_PUEM01000006.1 | Clostridium bolteae | 5630991 | 5631143 |
| NZ_PUEM01000006.1 | Clostridium bolteae | 199448 | 199687 |
| NZ_PUEM01000006.1 | Clostridium bolteae | 5725385 | 5725023 |
| NZ_PUEM01000006.1 | Clostridium bolteae | 5665475 | 5665690 |
| NZ_PUEM01000006.1 | Clostridium bolteae | 3020114 | 3019779 |
| NZ_PUEM01000006.1 | Clostridium bolteae | 627804 | 627544 |
| NZ_PUEM01000006.1 | Clostridium bolteae | 4780997 | 4781611 |
| CVOZ01000058.1 | Bacteroides thetaiotaomicron | 302431 | 301628 |
| CVOZ01000085.1 | Bacteroides thetaiotaomicron | 880 | 71 |
| JGCP01000704.1 | Bacteroides fragilis | 2340 | 1621 |
| JGCP01002431.1 | Bacteroides fragilis | 3248 | 2439 |
| NC_000913.3 | Escherichia coli | 3081620 | 3080886 |
| NC_000913.3 | Escherichia coli | 2579708 | 2580382 |
| NC_008618.1 | Bifidobacterium adolescentis | 1034957 | 1035538 |
| NC_009614.1 | Bacteroides vulgatus | 519272 | 518451 |
| NC_009614.1 | Bacteroides vulgatus | 2993131 | 2992328 |
| NC_009615.1 | Parabacteroides distasonis | 1971560 | 1972303 |
| NC_010655.1 | Akkermansia muciniphila | 622533 | 623279 |
| NC_012781.1 | Eubacterium rectale | 2329440 | 2328679 |
| NC_012781.1 | Eubacterium rectale | 301575 | 302372 |
| NZ_AAVM02000004.1 | Bacteroides caccae | 384982 | 384179 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_AAVN02000005.1 | Collinsella aerofaciens | 62689 | 63486 |
| NZ_AAVN02000007.1 | Collinsella aerofaciens | 30286 | 31083 |
| NZ_AAXA02000015.1 | Dorea formicigenerans | 777173 | 777955 |
| NZ_ABJL02000008.1 | Bacteroides intestinalis | 710350 | 709553 |
| NZ_ABJL02000008.1 | Bacteroides intestinalis | 872763 | 873572 |
| NZ_ABXA01000019.1 | Anaerococcus hydrogenalis | 83461 | 84240 |
| NZ_ABXA01000044.1 | Anaerococcus hydrogenalis | 26244 | 26918 |
| NZ_ABXWO1000004.1 | Providencia alcalifaciens | 192888 | 193562 |
| NZ_ACCL02000033.1 | Marvinbryantia formatexigens | 24594 | 25394 |
| NZ_ACEP01000106.1 | Eubacterium hallii | 34351 | 35028 |
| NZ_ACEP01000106.1 | Eubacterium hallii | 8467 | 9270 |
| NZ_AHVA01000007.1 | Salmonella enterica | 437205 | 436471 |
| NZ_ATFI01000008.1 | Bacteroides cellulosilyticus | 669051 | 668242 |
| NZ_CVOY01000079.1 | Bacteroides thetaiotaomicron | 7940 | 7137 |
| NZ_DS264265.1 | Eubacterium ventriosum | 121789 | 121150 |
| NZ_DS264270.1 | Eubacterium ventriosum | 131247 | 130783 |
| NZ_DS264282.1 | Eubacterium ventriosum | 44941 | 44159 |
| NZ_DS264382.1 | Ruminococcus torques | 15883 | 16695 |
| NZ_DS264541.1 | Parabacteroides merdae | 51592 | 50846 |
| NZ_DS264563.1 | Bacteroides ovatus | 129699 | 128896 |
| NZ_DS362241.1 | Bacteroides uniformis | 26081 | 26899 |
| NZ_DS362248.1 | Bacteroides uniformis | 10119 | 9310 |
| NZ_DS480669.1 | Clostridium bolteae | 172089 | 171322 |
| NZ_DS480671.1 | Clostridium bolteae | 270573 | 271247 |
| NZ_DS480676.1 | Clostridium bolteae | 208866 | 208069 |
| NZ_DS480683.1 | Clostridium bolteae | 59202 | 58459 |
| NZ_DS480723.1 | Clostridium bolteae | 62571 | 63365 |
| NZ_DS499654.1 | Erysipelatoclostridium ramosum | 493613 | 494332 |
| NZ_DS499659.1 | Erysipelatoclostridium ramosum | 506177 | 505422 |
| NZ_DS499673.1 | Bacteroides stercoris | 364819 | 364016 |
| NZ_DS499698.1 | Clostridium scindens | 88763 | 89650 |
| NZ_DS499698.1 | Clostridium scindens | 61808 | 61131 |
| NZ_DS499703.1 | Clostridium scindens | 55717 | 56514 |
| NZ_DS499718.1 | Clostridium scindens | 274306 | 273629 |
| NZ_DS544176.1 | Anaerotruncus colihominis | 236326 | 237081 |
| NZ_DS544185.1 | Anaerotruncus colihominis | 120251 | 119532 |
| NZ_DS544186.1 | Anaerotruncus colihominis | 57092 | 56349 |
| NZ_DS544190.1 | Anaerotruncus colihominis | 45026 | 45862 |
| NZ_DS544190.1 | Anaerotruncus colihominis | 194039 | 194773 |
| NZ_DS562849.1 | Clostridium spiroforme | 87327 | 88040 |
| NZ_DS607683.1 | Providencia stuartii | 286938 | 287612 |
| NZ_DS981517.1 | Clostridium sporogenes | 154420 | 155220 |
| NZ_DS990163.1 | Ruminococcus lactaris | 134129 | 134908 |
| NZ_DS990241.1 | Bifidobacterium longum | 301034 | 300396 |
| NZ_DS995509.1 | Bacteroides eggerthii | 1008704 | 1007901 |
| NZ_DS995528.1 | Bacteroides dorei | 103973 | 104794 |
| NZ_DS995535.1 | Bacteroides dorei | 358028 | 357237 |
| NZ_DS995537.1 | Bacteroides dorei | 338316 | 337513 |
| NZ_DS996445.1 | Parabacteroides johnsonii | 267454 | 266708 |
| NZ_DS996843.1 | Holdemanella biformis | 245401 | 244601 |
| NZ_DS996843.1 | Holdemanella biformis | 234112 | 233342 |
| NZ_DS996850.1 | Holdemanella biformis | 117033 | 116224 |
| NZ_DS996923.1 | Bacteroides pectinophilus | 107404 | 106727 |
| NZ_EQ973495.1 | Bacteroides cellulosilyticus | 691462 | 692142 |
| NZ_EQ973646.1 | Bacteroides coprophilus | 145177 | 144512 |
| NZ_GG657587.1 | Clostridium asparagiforme | 820313 | 821107 |
| NZ_GG657587.1 | Clostridium asparagiforme | 605673 | 604999 |
| NZ_GG657589.1 | Clostridium asparagiforme | 122006 | 121344 |
| NZ_GG657592.1 | Clostridium asparagiforme | 2356902 | 2356078 |
| NZ_GG657592.1 | Clostridium asparagiforme | 2681628 | 2680816 |
| NZ_GG657595.1 | Clostridium asparagiforme | 403564 | 402791 |
| NZ_GG657595.1 | Clostridium asparagiforme | 346373 | 345594 |
| NZ_GG661996.1 | Proteus penneri | 638905 | 638231 |
| NZ_GG662008.1 | Coprococcus comes | 8233 | 7436 |
| NZ_GG667643.1 | Hungatella hathewayi | 42915 | 43706 |
| NZ_GG667648.1 | Hungatella hathewayi | 3211 | 2381 |
| NZ_GG667661.1 | Hungatella hathewayi | 10879 | 11589 |
| NZ_GG667677.1 | Hungatella hathewayi | 17130 | 17855 |
| NZ_GG667681.1 | Hungatella hathewayi | 22622 | 21810 |
| NZ_GG667686.1 | Hungatella hathewayi | 4731 | 4012 |
| NZ_GG688324.1 | Bacteroides finegoldii | 86190 | 85387 |
| NZ_GG692711.1 | Collinsella intestinalis | 24582 | 23785 |
| NZ_GG692731.1 | Roseburia intestinalis | 6046 | 5264 |
| NZ_GG692741.1 | Roseburia intestinalis | 5968 | 5225 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_GG698590.1 | Blautia hansenii | 337693 | 338493 |
| NZ_GG703852.1 | Prevotella copri | 583896 | 584642 |
| NZ_GG704769.1 | Subdoligranulum variabile | 60450 | 61163 |
| NZ_GG704769.1 | Subdoligranulum variabile | 15116 | 14370 |
| NZ_GG704770.1 | Subdoligranulum variabile | 5362 | 6141 |
| NZ_GG704770.1 | Subdoligranulum variabile | 214747 | 215493 |
| NZ_GG704772.1 | Subdoligranulum variabile | 45873 | 45049 |
| NZ_GG704863.1 | Enterobacter cancerogenus | 2013656 | 2012844 |
| NZ_GG704863.1 | Enterobacter cancerogenus | 2101556 | 2102290 |
| NZ_GG704865.1 | Enterobacter cancerogenus | 539453 | 538719 |
| NZ_GG705265.1 | Providencia rettgeri | 100618 | 99944 |
| NZ_GG705267.1 | Providencia rettgeri | 66251 | 65577 |
| NZ_GG729830.1 | Bifidobacterium breve | 1233732 | 1233157 |
| NZ_GG739632.1 | Edwardsiella tarda | 145991 | 145257 |
| NZ_JGDE01000063.1 | Bacteroides fragilis | 109546 | 108737 |
| NZ_JH370371.1 | Alistipes indistinctus | 595517 | 596176 |
| NZ_JH724294.1 | Bacteroides xylanisolvens | 1474036 | 1473233 |
| NZ_KB946519.1 | Enterococcus faecalis | 1168242 | 1168913 |
| NZ_KE136402.1 | Enterococcus faecalis | 1933289 | 1932618 |
| NZ_KE992967.1 | Clostridium symbiosum | 16072 | 15284 |
| NZ_MTWC01000003.1 | Clostridioides difficile | 2436150 | 2435359 |
| NZ_MTWC01000003.1 | Clostridioides difficile | 3800319 | 3799558 |
| NZ_MTWD01000001.1 | Clostridioides difficile | 2478316 | 2477525 |
| NZ_MTWD01000001.1 | Clostridioides difficile | 3805291 | 3804530 |
| NZ_MTWE01000004.1 | Clostridioides difficile | 2193127 | 2192336 |
| NZ_MTWE01000004.1 | Clostridioides difficile | 3465381 | 3464620 |
| NZ_PUEL01000004.1 | Ruminococcus gnavus | 2090336 | 2089539 |
| NZ_PUEL01000004.1 | Ruminococcus gnavus | 2665987 | 2666715 |
| NZ_PUEM01000006.1 | Clostridium bolteae | 2861084 | 2861881 |
| NZ_PUEM01000006.1 | Clostridium bolteae | 6480829 | 6480086 |
| NZ_PUEM01000006.1 | Clostridium bolteae | 5430429 | 5429662 |
| NZ_PUEM01000006.1 | Clostridium bolteae | 238864 | 238070 |
| NZ_PUEM01000006.1 | Clostridium bolteae | 3207435 | 3208109 |
| NZ_PUEO01000014.1 | Bacteroides thetaiotaomicron | 2219764 | 2218961 |
| NZ_PUEP01000005.1 | Bacteroides ovatus | 2020302 | 2021105 |
| NZ_PUEQ01000003.1 | Bacteroides caccae | 1665493 | 1666296 |
| NZ_UFTH01000001.1 | Bacteroides fragilis | 3881025 | 3880216 |
| QEKH01000003.1 | Victivallis vadensis | 96465 | 97208 |
| CVOZ01000033.1 | Bacteroides thetaiotaomicron | 56026 | 56922 |
| JGCP01000335.1 | Bacteroides fragilis | 10772 | 11557 |
| JGCP01000867.1 | Bacteroides fragilis | 965 | 1840 |
| JGCP01001597.1 | Bacteroides fragilis | 61154 | 60237 |
| JGCP01002379.1 | Bacteroides fragilis | 46606 | 45821 |
| NC_000913.3 | Escherichia coli | 439100 | 438342 |
| NC_009614.1 | Bacteroides vulgatus | 518419 | 517508 |
| NC_009614.1 | Bacteroides vulgatus | 2260819 | 2259929 |
| NC_009615.1 | Parabacteroides distasonis | 3159114 | 3158230 |
| NC_010655.1 | Akkermansia muciniphila | 372524 | 373408 |
| NC_010655.1 | Akkermansia muciniphila | 1056059 | 1055319 |
| NC_012781.1 | Eubacterium rectale | 302528 | 303298 |
| NC_012781.1 | Eubacterium rectale | 2328598 | 2327729 |
| NC_012781.1 | Eubacterium rectale | 2064027 | 2063158 |
| NZ_AAVM02000003.1 | Bacteroides caccae | 171018 | 170122 |
| NZ_AAVN02000003.1 | Collinsella aerofaciens | 103150 | 102221 |
| NZ_AAVN02000005.1 | Collinsella aerofaciens | 63590 | 64447 |
| NZ_AAVN02000007.1 | Collinsella aerofaciens | 31218 | 32021 |
| NZ_AAXA02000003.1 | Dorea formicigenerans | 25120 | 25917 |
| NZ_AAXA02000014.1 | Dorea formicigenerans | 48489 | 49244 |
| NZ_AAXA02000015.1 | Dorea formicigenerans | 778056 | 778868 |
| NZ_ABJL02000008.1 | Bacteroides intestinalis | 709463 | 708594 |
| NZ_ABJL02000008.1 | Bacteroides intestinalis | 2841895 | 2842785 |
| NZ_ABXA01000019.1 | Anaerococcus hydrogenalis | 84625 | 85167 |
| NZ_ABXW01000004.1 | Providencia alcalifaciens | 141254 | 140499 |
| NZ_ACCL02000030.1 | Marvinbryantia formatexigens | 4571 | 5425 |
| NZ_ACCL02000033.1 | Marvinbryantia formatexigens | 25451 | 26320 |
| NZ_ACEP01000011.1 | Eubacterium hallii | 19574 | 20422 |
| NZ_ACEP01000106.1 | Eubacterium hallii | 9431 | 10198 |
| NZ_ACEP01000106.1 | Eubacterium hallii | 35117 | 36001 |
| NZ_ATFI01000004.1 | Bacteroides cellulosilyticus | 209297 | 210172 |
| NZ_CVOY01000004.1 | Bacteroides thetaiotaomicron | 16373 | 15477 |
| NZ_DS264265.1 | Eubacterium ventriosum | 120994 | 120227 |
| NZ_DS264270.1 | Eubacterium ventriosum | 130607 | 129840 |
| NZ_DS264282.1 | Eubacterium ventriosum | 44042 | 43233 |
| NZ_DS264284.1 | Eubacterium ventriosum | 144020 | 143178 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_DS264344.1 | Ruminococcus torques | 6063 | 6932 |
| NZ_DS264382.1 | Ruminococcus torques | 16851 | 17627 |
| NZ_DS264543.1 | Parabacteroides merdae | 27784 | 28650 |
| NZ_DS264584.1 | Bacteroides ovatus | 284623 | 283748 |
| NZ_DS362220.1 | Bacteroides uniformis | 227049 | 227918 |
| NZ_DS362248.1 | Bacteroides uniformis | 9278 | 8370 |
| NZ_DS480669.1 | Clostridium bolteae | 171259 | 170429 |
| NZ_DS480676.1 | Clostridium bolteae | 208042 | 207137 |
| NZ_DS480683.1 | Clostridium bolteae | 58433 | 57519 |
| NZ_DS480686.1 | Clostridium bolteae | 79885 | 79166 |
| NZ_DS480723.1 | Clostridium bolteae | 63515 | 64309 |
| NZ_DS480723.1 | Clostridium bolteae | 15660 | 16472 |
| NZ_DS499654.1 | Erysipelatoclostridium ramosum | 494370 | 495266 |
| NZ_DS499659.1 | Erysipelatoclostridium ramosum | 270170 | 269349 |
| NZ_DS499659.1 | Erysipelatoclostridium ramosum | 466874 | 467341 |
| NZ_DS499676.1 | Bacteroides stercoris | 578064 | 578954 |
| NZ_DS499697.1 | Clostridium scindens | 60279 | 61052 |
| NZ_DS499698.1 | Clostridium scindens | 89655 | 90635 |
| NZ_DS499698.1 | Clostridium scindens | 61039 | 60128 |
| NZ_DS499703.1 | Clostridium scindens | 56487 | 57446 |
| NZ_DS544176.1 | Anaerotruncus colihominis | 237039 | 237902 |
| NZ_DS544183.1 | Anaerotruncus colihominis | 240611 | 240078 |
| NZ_DS544185.1 | Anaerotruncus colihominis | 119250 | 118453 |
| NZ_DS544186.1 | Anaerotruncus colihominis | 56292 | 55369 |
| NZ_DS544190.1 | Anaerotruncus colihominis | 45937 | 46782 |
| NZ_DS544190.1 | Anaerotruncus colihominis | 195009 | 195800 |
| NZ_DS562849.1 | Clostridium spiroforme | 120673 | 120311 |
| NZ_DS607683.1 | Providencia stuartii | 189914 | 189132 |
| NZ_DS981517.1 | Clostridium sporogenes | 155283 | 156140 |
| NZ_DS981517.1 | Clostridium sporogenes | 1854924 | 1855802 |
| NZ_DS990163.1 | Ruminococcus lactaris | 134998 | 135867 |
| NZ_DS990181.1 | Ruminococcus lactaris | 125472 | 124558 |
| NZ_DS990181.1 | Ruminococcus lactaris | 82189 | 81734 |
| NZ_DS995509.1 | Bacteroides eggerthii | 308482 | 307574 |
| NZ_DS995528.1 | Bacteroides dorei | 104826 | 105737 |
| NZ_DS995535.1 | Bacteroides dorei | 357120 | 356392 |
| NZ_DS995536.1 | Bacteroides dorei | 378895 | 379785 |
| NZ_DS996456.1 | Parabacteroides johnsonii | 290834 | 289962 |
| NZ_DS996842.1 | Holdemanella biformis | 160953 | 161444 |
| NZ_DS996843.1 | Holdemanella biformis | 233309 | 232410 |
| NZ_DS996843.1 | Holdemanella biformis | 244454 | 243681 |
| NZ_DS996843.1 | Holdemanella biformis | 154069 | 154917 |
| NZ_DS996850.1 | Holdemanella biformis | 116083 | 115316 |
| NZ_DS996926.1 | Bacteroides pectinophilus | 25856 | 26650 |
| NZ_EQ973491.1 | Bacteroides cellulosilyticus | 377200 | 376325 |
| NZ_EQ973643.1 | Bacteroides coprophilus | 652762 | 653538 |
| NZ_GG657587.1 | Clostridium asparagiforme | 821211 | 822050 |
| NZ_GG657589.1 | Clostridium asparagiforme | 120718 | 120140 |
| NZ_GG657591.1 | Clostridium asparagiforme | 587188 | 587907 |
| NZ_GG657592.1 | Clostridium asparagiforme | 2680669 | 2679878 |
| NZ_GG657592.1 | Clostridium asparagiforme | 2356058 | 2355147 |
| NZ_GG657595.1 | Clostridium asparagiforme | 345552 | 344704 |
| NZ_GG657595.1 | Clostridium asparagiforme | 402646 | 401852 |
| NZ_GG661996.1 | Proteus penneri | 791418 | 792179 |
| NZ_GG662007.1 | Coprococcus comes | 99625 | 98906 |
| NZ_GG662008.1 | Coprococcus comes | 7280 | 6615 |
| NZ_GG667622.1 | Hungatella hathewayi | 66639 | 67460 |
| NZ_GG667643.1 | Hungatella hathewayi | 43732 | 44676 |
| NZ_GG667648.1 | Hungatella hathewayi | 2203 | 1409 |
| NZ_GG667661.1 | Hungatella hathewayi | 11831 | 12583 |
| NZ_GG667677.1 | Hungatella hathewayi | 17929 | 18831 |
| NZ_GG667681.1 | Hungatella hathewayi | 21744 | 21016 |
| NZ_GG667686.1 | Hungatella hathewayi | 3887 | 2979 |
| NZ_GG688317.1 | Bacteroides finegoldii | 362276 | 363025 |
| NZ_GG688320.1 | Bacteroides finegoldii | 281488 | 282357 |
| NZ_GG692711.1 | Collinsella intestinalis | 23654 | 22830 |
| NZ_GG692711.1 | Collinsella intestinalis | 69274 | 68498 |
| NZ_GG692726.1 | Roseburia intestinalis | 50658 | 51503 |
| NZ_GG692731.1 | Roseburia intestinalis | 5084 | 4749 |
| NZ_GG692731.1 | Roseburia intestinalis | 4582 | 4208 |
| NZ_GG692741.1 | Roseburia intestinalis | 5015 | 4245 |
| NZ_GG693674.1 | Lactobacillus reuteri | 15204 | 14458 |
| NZ_GG698589.1 | Blautia hansenii | 218497 | 219342 |
| NZ_GG698590.1 | Blautia hansenii | 338622 | 339425 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
| --- | --- | --- | --- |
| NZ_GG703865.1 | Prevotella copri | 41671 | 42546 |
| NZ_GG704769.1 | Subdoligranulum variabile | 14262 | 13399 |
| NZ_GG704769.1 | Subdoligranulum variabile | 61204 | 62076 |
| NZ_GG704769.1 | Subdoligranulum variabile | 963668 | 963213 |
| NZ_GG704770.1 | Subdoligranulum variabile | 6326 | 7123 |
| NZ_GG704770.1 | Subdoligranulum variabile | 215601 | 216464 |
| NZ_GG704772.1 | Subdoligranulum variabile | 44998 | 44135 |
| NZ_GG704863.1 | Enterobacter cancerogenus | 2012671 | 2011880 |
| NZ_GG704864.1 | Enterobacter cancerogenus | 137859 | 137101 |
| NZ_GG705265.1 | Providencia rettgeri | 155499 | 156254 |
| NZ_GG705267.1 | Providencia rettgeri | 65114 | 64578 |
| NZ_GG729830.1 | Bifidobacterium breve | 720986 | 720603 |
| NZ_GG739633.1 | Edwardsiella tarda | 373885 | 373130 |
| NZ_JDUD01000004.1 | Bifidobacterium breve | 259935 | 260318 |
| NZ_JGDE01000029.1 | Bacteroides fragilis | 56625 | 55840 |
| NZ_JGDE01000151.1 | Bacteroides fragilis | 69580 | 68663 |
| NZ_JH370371.1 | Alistipes indistinctus | 1294336 | 1295106 |
| NZ_JH724294.1 | Bacteroides xylanisolvens | 373560 | 372685 |
| NZ_KB946519.1 | Enterococcus faecalis | 955995 | 956768 |
| NZ_KE136402.1 | Enterococcus faecalis | 2137928 | 2137155 |
| NZ_KE992967.1 | Clostridium symbiosum | 15212 | 14295 |
| NZ_MTWC01000003.1 | Clostridioides difficile | 2435248 | 2434466 |
| NZ_MTWC01000003.1 | Clostridioides difficile | 3799403 | 3798573 |
| NZ_MTWC01000003.1 | Clostridioides difficile | 1160536 | 1161309 |
| NZ_MTWD01000001.1 | Clostridioides difficile | 2477414 | 2476632 |
| NZ_MTWD01000001.1 | Clostridioides difficile | 3804375 | 3803584 |
| NZ_MTWD01000001.1 | Clostridioides difficile | 1257043 | 1257816 |
| NZ_MTWD01000001.1 | Clostridioides difficile | 73882 | 74589 |
| NZ_MTWE01000004.1 | Clostridioides difficile | 2192225 | 2191443 |
| NZ_MTWE01000004.1 | Clostridioides difficile | 3464465 | 3463635 |
| NZ_MTWE01000004.1 | Clostridioides difficile | 960760 | 961533 |
| NZ_PUEL01000004.1 | Ruminococcus gnavus | 2089383 | 2088613 |
| NZ_PUEL01000004.1 | Ruminococcus gnavus | 2666757 | 2667680 |
| NZ_PUEL01000004.1 | Ruminococcus gnavus | 794583 | 793762 |
| NZ_PUEM01000006.1 | Clostridium bolteae | 5429599 | 5428769 |
| NZ_PUEM01000006.1 | Clostridium bolteae | 2861908 | 2862813 |
| NZ_PUEM01000006.1 | Clostridium bolteae | 237920 | 237126 |
| NZ_PUEM01000006.1 | Clostridium bolteae | 6480060 | 6479146 |
| NZ_PUEM01000006.1 | Clostridium bolteae | 3429828 | 3430547 |
| NZ_PUEM01000006.1 | Clostridium bolteae | 285775 | 284963 |
| NZ_PUEO01000014.1 | Bacteroides thetaiotaomicron | 882473 | 881577 |
| NZ_PUEP01000005.1 | Bacteroides ovatus | 3161127 | 3162002 |
| NZ_PUEQ01000003.1 | Bacteroides caccae | 2533958 | 2534854 |
| NZ_UFTH01000001.1 | Bacteroides fragilis | 2923509 | 2922724 |
| NZ_UFTH01000001.1 | Bacteroides fragilis | 1585432 | 1584515 |
| QEKH01000019.1 | Victivallis vadensis | 59802 | 59029 |
| CVOZ01000028.1 | Bacteroides thetaiotaomicron | 11708 | 11028 |
| CVOZ01000041.1 | Bacteroides thetaiotaomicron | 276698 | 276060 |
| JGCP01000929.1 | Bacteroides fragilis | 984 | 1961 |
| JGCP01001512.1 | Bacteroides fragilis | 86 | 724 |
| JGCP01002412.1 | Bacteroides fragilis | 4520 | 5224 |
| NC_000913.3 | Escherichia coli | 1858800 | 1858150 |
| NC_000913.3 | Escherichia coli | 1653876 | 1653256 |
| NC_000913.3 | Escherichia coli | 3791303 | 3790323 |
| NC_000913.3 | Escherichia coli | 2172858 | 2172232 |
| NC_000913.3 | Escherichia coli | 1861305 | 1860268 |
| NC_000913.3 | Escherichia coli | 4494313 | 4493675 |
| NC_000913.3 | Escherichia coli | 2675722 | 2674703 |
| NC_000913.3 | Escherichia coli | 4596053 | 4596487 |
| NC_000913.3 | Escherichia coli | 4496182 | 4495505 |
| NC_000913.3 | Escherichia coli | 379529 | 378861 |
| NC_008618.1 | Bifidobacterium adolescentis | 412571 | 413026 |
| NC_008618.1 | Bifidobacterium adolescentis | 417228 | 418223 |
| NC_009614.1 | Bacteroides vulgatus | 341339 | 342010 |
| NC_009614.1 | Bacteroides vulgatus | 4657957 | 4657250 |
| NC_009615.1 | Parabacteroides distasonis | 1570183 | 1569347 |
| NC_009615.1 | Parabacteroides distasonis | 2557870 | 2557166 |
| NC_010655.1 | Akkermansia muciniphila | 292548 | 291571 |
| NC_010655.1 | Akkermansia muciniphila | 2578712 | 2579362 |
| NC_012781.1 | Eubacterium rectale | 1291708 | 1292388 |
| NZ_AAVM02000004.1 | Bacteroides caccae | 12927 | 13637 |
| NZ_AAYG02000009.1 | Ruminococcus gnavus | 126809 | 127438 |
| NZ_AAYG02000009.1 | Ruminococcus gnavus | 97702 | 98343 |
| NZ_ABJL02000008.1 | Bacteroides intestinalis | 1955633 | 1955031 |

TABLE 2-continued

Nucleic acid sequences encoding drug-metabolizing gene products (identified by start nucleotide and end nucleotide in the listed contigs in the mentioned bacterial species, as disclosed in Zimmermann et al. (2019) Nature 570(7762): 462-467).

| NCBI_NUCCORE_ID | SPECIES | START | END |
|---|---|---|---|
| NZ_ABJL02000008.1 | Bacteroides intestinalis | 2224108 | 2223404 |
| NZ_ABXW01000004.1 | Providencia alcalifaciens | 273231 | 272242 |
| NZ_ABXW01000070.1 | Providencia alcalifaciens | 85714 | 84734 |
| NZ_ACCL02000009.1 | Marvinbryantia formatexigens | 148973 | 147954 |
| NZ_ACCL02000012.1 | Marvinbryantia formatexigens | 119480 | 120445 |
| NZ_ACCL02000023.1 | Marvinbryantia formatexigens | 25242 | 24913 |
| NZ_ACCL02000041.1 | Marvinbryantia formatexigens | 6824 | 5856 |
| NZ_AHVA01000007.1 | Salmonella enterica | 629177 | 629791 |
| NZ_AHVA01000007.1 | Salmonella enterica | 443202 | 442726 |
| NZ_ATFI01000005.1 | Bacteroides cellulosilyticus | 148491 | 147889 |
| NZ_ATFI01000005.1 | Bacteroides cellulosilyticus | 281258 | 280554 |
| NZ_CVOY01000006.1 | Bacteroides thetaiotaomicron | 74981 | 74301 |
| NZ_CVOY01000028.1 | Bacteroides thetaiotaomicron | 60888 | 60250 |
| NZ_DS264270.1 | Eubacterium ventriosum | 132077 | 133096 |
| NZ_DS264356.1 | Ruminococcus torques | 135544 | 134918 |
| NZ_DS264356.1 | Ruminococcus torques | 138887 | 137853 |
| NZ_DS264581.1 | Bacteroides ovatus | 127382 | 127984 |
| NZ_DS264584.1 | Bacteroides ovatus | 820339 | 821043 |
| NZ_DS362249.1 | Bacteroides uniformis | 410760 | 410056 |
| NZ_DS480663.1 | Clostridium bolteae | 23590 | 22595 |
| NZ_DS480674.1 | Clostridium bolteae | 133468 | 132818 |
| NZ_DS480677.1 | Clostridium bolteae | 49418 | 50098 |
| NZ_DS480679.1 | Clostridium bolteae | 3487 | 2807 |
| NZ_DS480681.1 | Clostridium bolteae | 101114 | 100101 |
| NZ_DS480681.1 | Clostridium bolteae | 102205 | 101171 |
| NZ_DS480683.1 | Clostridium bolteae | 55885 | 54905 |
| NZ_DS480685.1 | Clostridium bolteae | 12651 | 11935 |
| NZ_DS499659.1 | Erysipelatoclostridium ramosum | 699981 | 700592 |
| NZ_DS499667.1 | Bacteroides stercoris | 9893 | 10597 |
| NZ_DS499698.1 | Clostridium scindens | 90702 | 91751 |
| NZ_DS499700.1 | Clostridium scindens | 26495 | 25524 |
| NZ_DS499701.1 | Clostridium scindens | 129720 | 128749 |
| NZ_DS499706.1 | Clostridium scindens | 53386 | 54207 |
| NZ_DS499706.1 | Clostridium scindens | 60521 | 61132 |
| NZ_DS499706.1 | Clostridium scindens | 79791 | 80414 |
| NZ_DS499706.1 | Clostridium scindens | 26668 | 27222 |
| NZ_DS499706.1 | Clostridium scindens | 49864 | 50862 |
| NZ_DS499718.1 | Clostridium scindens | 277445 | 276753 |
| NZ_DS544175.1 | Anaerotruncus colihominis | 165749 | 166231 |
| NZ_DS544175.1 | Anaerotruncus colihominis | 34216 | 34839 |
| NZ_DS544185.1 | Anaerotruncus colihominis | 127019 | 126309 |
| NZ_DS544190.1 | Anaerotruncus colihominis | 38245 | 39264 |
| NZ_DS607671.1 | Providencia stuartii | 138632 | 139612 |
| NZ_DS981517.1 | Clostridium sporogenes | 1442433 | 1443440 |
| NZ_DS981517.1 | Clostridium sporogenes | 128139 | 128786 |
| NZ_DS981517.1 | Clostridium sporogenes | 1549649 | 1550068 |
| NZ_DS990194.1 | Ruminococcus lactaris | 63868 | 63188 |
| NZ_DS995508.1 | Bacteroides eggerthii | 161989 | 161351 |
| NZ_DS995531.1 | Bacteroides dorei | 1763 | 1143 |
| NZ_DS995533.1 | Bacteroides dorei | 81701 | 82408 |
| NZ_DS995533.1 | Bacteroides dorei | 169186 | 169599 |
| NZ_DS996842.1 | Holdemanella biformis | 209702 | 208998 |
| NZ_EQ973491.1 | Bacteroides cellulosilyticus | 1310769 | 1311371 |
| NZ_EQ973491.1 | Bacteroides cellulosilyticus | 1172397 | 1173101 |
| NZ_EQ973637.1 | Bacteroides coprophilus | 197189 | 197566 |
| NZ_GG657587.1 | Clostridium asparagiforme | 63925 | 64557 |
| NZ_GG657587.1 | Clostridium asparagiforme | 528913 | 529482 |
| NZ_GG657591.1 | Clostridium asparagiforme | 956107 | 956775 |
| NZ_GG657591.1 | Clostridium asparagiforme | 483157 | 483576 |
| NZ_GG657591.1 | Clostridium asparagiforme | 577856 | 578869 |
| NZ_GG657591.1 | Clostridium asparagiforme | 710248 | 710910 |
| NZ_GG657592.1 | Clostridium asparagiforme | 1127425 | 1126616 |
| NZ_GG657592.1 | Clostridium asparagiforme | 1430381 | 1431352 |
| NZ_GG657592.1 | Clostridium asparagiforme | 2752837 | 2753874 |

REFERENCES

1. Massip, C. et al. Deciphering the interplay between the genotoxic and probiotic activities of *Escherichia coli* Nissle 1917. *Plos Pathog* 15, e1008029 (2019).
2. Gil-Cruz, C. et al. Microbiota-derived peptide mimics drive lethal inflammatory cardiomyopathy. *Science* 366, 881-886 (2019).
3. Dreux, N. et al. Point Mutations in FimH Adhesin of Crohn's Disease-Associated Adherent-Invasive *Escherichia coli* Enhance Intestinal Inflammatory Response. *Plos Pathog* 9, e1003141 (2013).
4. Zou, D. et al. A SNP of bacterial blc disturbs gut lysophospholipid homeostasis and induces inflammation through epithelial barrier disruption. *Ebiomedicine* 52, 102652 (2020).
5. Tomida, S. et al. Pan-Genome and Comparative Genome Analyses of *Propionibacterium acnes* Reveal Its Genomic Diversity in the Healthy and Diseased Human Skin Microbiome. *mBio* 4, e00003-13 (2013).
6. Negi, S., Singh, H. & Mukhopadhyay, A. Gut bacterial peptides with autoimmunity potential as environmental trigger for late onset complex diseases: In-silico study. *Plos One* 12, e0180518 (2017).
7. Greiling, T. M. et al. Commensal orthologs of the human autoantigen Ro60 as triggers of autoimmunity in lupus. *Sci Transl Med* 10, eaan2306 (2018).
8. Garcia, A. R. et al. Peripheral tolerance to insulin is encoded by mimicry in the microbiome. *Biorxiv* 2019.12.18.881433 (2019) doi:10.1101/2019.12.18.881433.
9. Rees, H. A. & Liu, D. R. Base editing: precision chemistry on the genome and transcriptome of living cells. *Nat Rev Genet* 19, 770-788 (2018).
10. Anzalone, A. V. et al. Search-and-replace genome editing without double-strand breaks or donor DNA. *Nature* 576, 149-157 (2019).
11. Sharon, E. et al. Functional Genetic Variants Revealed by Massively Parallel Precise Genome Editing. *Cell* 175, 544-557.e16 (2018).
12. Farzadfard, F. & Lu, T. K. Genomically encoded analog memory with precise in vivo DNA writing in living cell populations. *Science* 346, 1256272 (2014).
13. Wannier, T. M. et al. Improved bacterial recombineering by parallelized protein discovery. *Biorxiv* 2020.01.14.906594 (2020) doi:10.1101/2020.01.14.906594.
14. Karberg, M. et al. Group II introns as controllable gene targeting vectors for genetic manipulation of bacteria. *Nat Biotechnol* 19, 1162-7 (2001).
15. Simon, A. J., Ellington, A. D. & Finkelstein, I. J. Retrons and their applications in genome engineering. *Nucleic Acids Res* 47, 11007-11019 (2019).
16. Jinek, M. et al. A programmable dual-RNA-guided DNA endonuclease in adaptive bacterial immunity. *Sci New York N.Y.* 337, 816-21 (2012).
17. Cox, D. B. T. et al. RNA editing with CRISPR-Cas13. *Science* 358, 1019-1027 (2017).
18. Koonin, E. V., Makarova, K. S. & Zhang, F. Diversity, classification and evolution of CRISPR-Cas systems. *Current Opinion in Microbiology* 37, 67-78 (2017).
19. Makarova, K. S. et al. Evolutionary classification of CRISPR-Cas systems: a burst of class 2 and derived variants. *Nat Rev Microbiol* 18, 67-83 (2020).
20. Fonfara, I. et al. Phylogeny of Cas9 determines functional exchangeability of dual-RNA and Cas9 among orthologous type II CRISPR-Cas systems. *Nucleic Acids Research* 42, 2577-2590 (2014).
21. Abudayyeh, O. O. et al. RNA targeting with CRISPR-Cas13. *Nature* 550, 280 (2017).
22. Costa, T. R. D. et al. Secretion systems in Gram-negative bacteria: structural and mechanistic insights. *Nat Rev Microbiol* 13, 343-359 (2015).
23. Anne, J., Economou, A. & Bernaerts, K. Protein and Sugar Export and Assembly in Gram-positive Bacteria. 267-308 (2016) doi:10.1007/82_2016_49.
24. Camprubi-Font, C., Ewers, C., Lopez-Siles, M. & Martinez-Medina, M. Genetic and Phenotypic Features to Screen for Putative Adherent-Invasive *Escherichia coli*. *Front Microbiol* 10, 108 (2019).
25. Camprubi-Font, C., Castillo, B. R. D., Barrabés, S., Martinez-Martinez, L. & Martinez-Medina, M. Amino Acid Substitutions and Differential Gene Expression of Outer Membrane Proteins in Adherent-Invasive *Escherichia coli*. Front Microbiol 10, 1707 (2019).
26. Wang, I.-N. Lysis Timing and Bacteriophage Fitness. Genetics 172, 17-26 (2005).
27. Meric, G. et al. Disease-associated genotypes of the commensal skin bacterium *Staphylococcus epidermidis*. Nat Commun 9, 5034 (2018).
28. Ruff, W. E. et al. Pathogenic Autoreactive T and B Cells Cross-React with Mimotopes Expressed by a Common Human Gut Commensal to Trigger Autoimmunity. Cell Host Microbe 26, 100-113.e8 (2019).
29. Chen, L et al. Precise and programmable C:G to G:C base editing in genomic DNA. Biorxiv (2020).
30. Kurt, I et al. CRISPR C-to-G base editors for inducing targeted DNA transversions in human cells. Nature Biotechnology (2020).
31. Zhao, D et al. New base editors change C to A in bacteria and C to G in mammalian cells. Nature Biotechnology (2020).
32. Komor, A et al. Programmable editing of a target base in genomic DNA without double-stranded DNA cleavage. Nature 533:420-4. (2016).
33. Gaudelli, N. M. et al. Programmable base editing of A•T to G•C in genomic DNA without DNA cleavage. Nature 551(7681) 464-471 (2017).
34. Liu, D et al. A:T to C:G base editors and uses thereof. Patent application WO2020181180 (2020).
35. Liu, D et al. A:T to T:A base editing through adenine deamination and oxidation. Patent application WO2020181202 (2020).
36. Liu, D et al. T:A TO A:T base editing through adenosine methylation. Patent application WO2020181193 (2020).
37. Liu, D et al. T:A TO A:T base editing through thymine alkylation. Patent application WO2020181178 (2020).
38. Liu, D et al. T:A TO A:T base editing through adenine excision. Patent application WO2020181195 (2020).
39. Grunewald, J et al. A dual-deaminase CRISPR base editor enables concurrent adenine and cytosine editing, Nature Biotechnology (2020).
40. Li, C et al. Targeted, random mutagenesis of plant genes with dual cytosine and adenine base editors, Nature Biotechnology (2020).
41. Chen et al. Programmable C:G to G:C genome editing with CRISPR-Cas9-directed base excision repair proteins. Nature Communications 12:1384 (2021)

SEQUENCE LISTING (2325 sequences)

SEQ ID NO: 1 - DNA, 11268 bp, Artificial Sequence
  Payload encoding Adenine base editor (ABE8e) and guideRNA targeting mCherry
cgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaagtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaactactagaagagcgattgggctcttcaatgaagcgtaccgccgatggcagcgagtttgaatctccgaagaaaaagcgtaaggtcagcgaagttgagttcagccacgaatactggatgcgtcacgctttaaccctggctaaacgcgcgcgcgacgagcgcgaagtaccagtgggggcggtgctggtgttaaacaaccgcgtaatcggcgaaggctggaaccgtgcaatcgggttacatgacccgaccgcccatgccgagatcatggccctgcgccagggggggctggtcatgcagaattaccgtctgatcgacgcgacgttgtatgtcacattcgagccatgcgtgatgtgtgcgggggcaatgattcactctcgcattggtcgcgtcgtgtttggcgttcgtaatagtaaacgcggcgctgctggctccttaatgaatgttctgaattatccgggtatgaaccaccgtgtcgaaattacagaaggtatcttagcagatgaatgtgccgcactgctgtgtgacttctaccgcatgccgcgccaagtattcaacgcccaaaaaaaagctcagtcctcaattaactctggtggtagtagtggcggctctagcggctccgagacgcctggtacgtcggaatcggctacgcctgagtcgagcggtgggtcctctggcggctctgacaagaaatatagcatcggcctggccatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgaccacattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgactaatgtatgcttaagcagctcggtaccaaagacgaacaataagacgctgaaaagcgtcttttttcgttttggtcctgttgcggcgcgatagtgtgaacatgctatagacttctggtgctacccgactgacaattaatcatccggctcgtataatgctagccgtacataaattgcgggctcgttttagagctagaaatagcaagttaaaataaggctagtccgttatcaacttgaaaaagtggcaccgagtcggtgctttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtagg

SEQ ID NO: 2 - DNA, 11257 bp, Artificial Sequence
  Payload encoding Adenine base editor (ABE8e) and guideRNA targeting _-lactamase
cgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaagtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaacggatagaaatgggagatgaagcgtaccgccgatggcagcgagtttgaatctccgaagaaaaagcgtaaggtcagcgaagttgagttcagccacgaatactggatgcgtcacgctttaaccctggctaaacgcgcgcgcgacgagcgcgaagtaccagtgggggcggtgctggtgttaaacaaccgcgtaatcggcgaaggctggaaccgtgcaatcgggttacatgacccgaccgcccatgccgagatcatggccctgcgccagggggggctggtcatgcagaattaccgtctgatcgacgcgacgttgtatgtcacattcgagccatgcgtgatgtgtgcgggggcaatgattcactctcgcattggtcgcgtcgtgtttggcgttcgtaatagtaaacgcggcgctgctggctccttaatgaatgttctgaattatccgggtatgaaccaccgtgtcgaaattacagaaggtatcttagcagatgaatgtgccgcactgctgtgtgacttctaccgcatgccgcgccaagtattcaacgcccaaaaaaaagctcagtcctcaattaactctggtggtagtagtggcggctctagcggctccgagacgcctggtacgtcggaatcggctacgcctgagtcgagcggtgggtcctctggcggctctgacaagaaatatagcatcggcctggccatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgaccacattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgactaatgtatgcttaagcagctcggtaccaaagacgaacaataagacgctgaaaagcgtcttttttcgttttggtcctgttgcggcgcgatagtgtgaacatgctatagacttctggtgctacccgactgacaattaatcatccggctcgtataatgctagcacttttaaagttctgctatggttttagagctagaaatagcaagttaaaataaggctagtccgttatcaacttgaaaaagtggcaccgagtcggtgctttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtagg

SEQ ID NO: 3 - DNA, 11733 bp, Artificial Sequence
  Payload encoding Cytosine base editor (evoAPOBEC1-nCas9-UGI) and guideRNA targeting mCherry
cgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaagtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaactactagaagagcgattgggctcttcaatgaaacgtactgccgacggttcagagttcgagtcgcccaagaagaaacgtaaagtgtcatccaaaaccggcccagttgcggtggacccaacgctgcgccgtcgtatcgaaccgcacgagttcgaagtatttttcgatcctcgcgaactgcgtaaagagacctgtttactttacgaaatcaattggggtggccgccactcgatttggcgccacacgtctcagaatacaaacaaacatgtcgaagtaaatttcatcgaaaaatttacaacggagcgttatttctgtcccaatactcgttgttctattacatggtttttatcatggagtccctgcggggaatgctctcgtgcgatcacggagtttctgtcgcgttatccgaacgtaacgctttttatctatattgctcgtctttaccacttggctaaccctcgtaaccgccaaggacttcgcgacctgatttcgagtggagtaaccatccagatcatgactgagcaagaatctggatactgttggcacaatttcgtaaactactcgccatcgaatgagagccattggcctcgctacccccatctttgggtacgtttgtatgtcttggaactttattgtatcattttagggctgccaccttgtcttaatattttgcgccgcaaacagagtcagctgacatctttcacaattgctttacagtcatgccactaccaacgtcttccaccgcacattctgtgggccacgggcttaaaatcgggcggtagctcaggcgggagttcaggctcagaaacgccgggaactagcgaatccgcaacgccagagtcttcaggtggttcgtcaggtggttcagacaagaaatatagcatcggcctggccatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgaccacattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgacagtgggggcagcggaggtagcggaggcagcactaatttgtcggatattattgagaaggaaacaggaaagcaattggttatccaggaatccattttaatgcttccggaagaagtggaagaggtgatcggaaataagccagagagcgatatcttagttcatacggcctatgatgaaagcactgacgagaacgttatgctgttaacatcggacgctcccgagtacaagccgtgggccctggttatccaggacagtaatggcgaaaataaaattaaaatgttataatgtatgcttaagcagctcggtaccaaagacgaacaataagacgctgaaaagcgtcttttttcgttttggtcctgttgcggcgcgatagtgtgaacatgctatagacttctggtgctacccgactgacaattaatcatccggctcgtataatgctagccactcaggactcctccctgcgttttagagctagaaatagcaagttaaaataaggctagtccgttatcaacttgaaaaagtggcaccgagtcggtgctttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtagg

SEQ ID NO: 4 - DNA, 11731 bp, Artificial Sequence
  Payload encoding Cytosine base editor (evoAPOBEC1-nCas9-UGI) and guideRNA targeting _-lactamase
cgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaagtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaaccaggataaagagagagcatactcgatgaaacgtactgccgacggttcagagttcgagtcgcccaagaagaaacgtaaagtgtcatccaaaaccggcccagttgcggtggacccaacgctgcgccgtcgtatcgaaccgcacgagttcgaagtatttttcgatcctcgcgaactgcgtaaagagacctgtttactttacgaaatcaattggggtggccgccactcgatttggcgccacacgtctcagaatacaaacaaacatgtcgaagtaaatttcatcgaaaaatttacaacggagcgttatttctgtcccaatactcgttgttctattacatggtttttatcatggagtccctgcggggaatgctctcgtgcgatcacggagtttctgtcgcgttatccgaacgtaacgctttttatctatattgctcgtctttaccacttggctaaccctcgtaaccgccaaggacttcgcgacctgatttcgagtggagtaaccatccagatcatgactgagcaagaatctggatactgttggcacaatttcgtaaactactcgccatcgaatgagagccattggcctcgctacccccatctttgggtacgtttgtatgtcttggaactttattgtatcattttagggctgccaccttgtcttaatattttgcgccgcaaacagagtcagctgacatctttcacaattgctttacagtcatgccactaccaacgtcttccaccgcacattctgtgggccacgggcttaaaatcgggcggtagctcaggcgggagttcaggctcagaaacgccgggaactagcgaatccgcaacgccagagtcttcaggtggttcgtcaggtggttcagacaagaaatatagcatcggcctggccatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgaccacattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgacagtgggggcagcggaggtagcggaggcagcactaatttgtcggatattattgagaaggaaacaggaaagcaattggttatccaggaatccattttaatgcttccggaagaagtggaagaggtgatcggaaataagccagagagcgatatcttagttcatacggcctatgatgaaagcactgacgagaacgttatgctgttaacatcggacgctcccgagtacaagccgtgggccctggttatccaggacagtaatggcgaaaataaaattaaaatgttataatgtatgcttaagcagctcggtaccaaagacgaacaataagacgctgaaaagcgtcttttttcgttttggtcctgttgcggcgcgatagtgtgaacatgctatagacttctggtgctacccgactgacaattaatcatccggctcgtataatgctagcctcgtcaacaattaatagacgttttagagctagaaatagcaagttaaaataaggctagtccgttatcaacttgaaaaagtggcaccgagtcggtgctttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtagg

SEQ ID NO: 5 - DNA, 711 bp, Artificial Sequence
  mCherry gene
atggtttccaagggcgaggaggataacatggctatcattaaagagttcatgcgcttcaaagttcacatggagggttctgttaacggtcacgagttcgagatcgaaggcgaaggcgagggccgtccgtatgaaggcacccagaccgccaaactgaaagtgactaaaggcggcccgctgccttttgcgtgggacatcctgagcccgcaatttatgtacggttctaaagcttatgttaaacacccagcggatatcccggactatctgaagctgtcttttccggaaggtttcaagtgggaacgcgtaatgaattttgaagatggtggtgtcgtgaccgtcactcaggactcctccctgcaggatggcgagttcatctataaagttaaactgcgtggtactaattttccatctgatggcccggtgatgcagaagaagacgatgggttgggaggcgtctagcgaacgcatgtatccggaagatggtgcgctgaaaggcgaaattaaacagcgcctgaaactgaaagatggcggccattatgacgctgaagtgaaaaccacgtacaaagccaagaaacctgtgcagctgcctggcgcgtacaatgtgaatattaaactggacatcacctctcataatgaagattatacgatcgtagagcaatatgagcgcgcggagggtcgtcattctaccggtggcatggatgagctgtacaaataa

SEQ ID NO: 6 - DNA, 861 bp, Artificial Sequence
  _-lactamase gene
atgagtattcaacatttccgtgtcgcccttattcccttttttgcggcattttgccttcctgtttttgctcacccagaaacgctggtgaaagtaaaagacgctgaggatcagttgggagcccgtgtgggttacatcgagctggatctcaacagcggtaagatccttgagagttttcgccccgaagaacgttttccaatgatgagcacttttaaagttctgctatgtggcgcggtattatcccgtgttgatgccggacaagagcaacttggtcgccgtatacactattctcagaatgacttggttgagtactcaccagttaccgaaaagcatcttacggatggcatgacagtaagagaattatgcagtgctgccataaccatgagtgataacacggcagccaacttacttctgacaacgatcggagggccgaaggagctaaccgcttttttgcacaacatgggggatcatgtaactcgccttgatcgttgggagccggagctgaatgaagccataccaaacgacgagcgtgacaccacgatgcccgcagcaatggcaacaacgttgcgcaaactattaactggcgaactacttactctagcttctcgtcaacaattaatagactggatggaggcggataaagttgcaggcccacttctgcgttcggcccttccggctggctggtttattgctgataaatctggagcaggcgagcgtggatctcgcggtatcattgcagcactggggccagatggtaagccctcccgtatcgtagttatctacacgacggggagtcaggcaactatggatgaacgaaatagacagatcgctgagataggtgcatcactgattaagcattggtaa

SEQ ID NO: 7 - DNA, 282 bp, Artificial Sequence
  Primase ori deltaGAAABCC
tttgttgcaatggctgtctaccctgtctacctgagtaaagaaaaatacatttaattcagtacattaacttgggtagacagcctttttttactgtctacctactatctaccctctctacctgattttacctgaatcagacagggaggtagatacggggtagatagtggataaaagcactctaccccactgaaagcagcgccattactggcatggtggccagtaaggtagataaggtagacaaggggaggcacaactcaaaactttttaaacgagggggtaaaa

SEQ ID NO: 8 - DNA, 282 bp, Artificial Sequence
  Primase ori devoid of restriction sites
tttgttgcaatggctgtctaccctgtctacctgagtaaagaaaaatacatttaattcagtatattaacttgggtagacagcctttttttactgtctaccttctgtctaccctctctacctgattttacctgaatcagacagggaggtagacacggggtagacagtggataaaagcactctaccccactgaaagcagtgccattactggcatggttgccagtaaggttgataaggtagacaaggggagggacaactcaaaactttttaaacgagggggtaaaa

SEQ ID NO: 9 - protein, 17 aa, Artificial Sequence
  insulin B9-25 epitope
SHLVEALYLVCGERGFF

SEQ ID NO: 10 - protein, 15 aa, Artificial Sequence
  T cell (_2GPI) epitope
KVSFFCKNKEKKCSY

SEQ ID NO: 11 - protein, 11 aa, Artificial Sequence
  B cell epitope
VSRGGMRKFIC

SEQ ID NO: 12 - DNA, 282 bp, Artificial Sequence
  primase ori from the PICI of the Escherichia coli strain CFT073
tttgttgcaatggctgtctaccctgtctacctgagtaaagaaaaatacatttaattcagtacattaacttgggtagacagcctttttttactgtctacctactatctaccctctctacctgattttacctgaatcagacagggaggtagatacggggtagatagtggataaaagcactctaccccactgaaagccgcgccattactggcatggtggccagtaaggtagataaggtagacaaggggaggcacaactcaaaactttttaaacgagggggtaaaa

SEQ ID NO: 13 - DNA, 13 bp, Artificial Sequence
  restriction site
  misc_feature (5)..(10): n is a, c, g, or t
twcannnnnntgg

SEQ ID NO: 14 - protein, 584 aa, Artificial Sequence
  PICI primase-helicase
MKLAPNVKQQSRGIKHKETEVIIFAGSDAWSHAKQWQEHDARMAGDNEPPVWLGEQQLSELDKLQIVPEGRKSVRIFRAGYLAPVMIKAIGQKLAAAGVQDANFYPDGMHGQKVENWREYLARERQNLSDGLVIELPVKQKAQLSQMADSERAQLLADRFDGVCVHPESEIVHVWCGGVWCPVSTMELSREMVAIYSEHRATFSKRVINNAVEALKVIAEPMGEPSGDLLPFANGALDLKTGEFSPHTPENWITTHNGIEYTPPAPGENIRDNAPNFHKWLEHAAGKDPRKMMRICAALYMIMANRYDWQMFIEATGDGGSGKSTFTHIASLLAGKQNTVSAEMTSLDDAGGRAQVVGSRLIVLADQPKYTGEGTGIKKITGGDPVEINPKYEKRFTAVIRAVVLATNNNPMIFTERAGGVARRRVIFRFDNIVSEAEKDRELPEKIAAEIPVIIRRLLANFADPEKARALLIEQRDGDEALAIKQQTDPVIEFCQFLNFLEEARGLMMGGGGDSVKYTTRNSLYRVYLAFMAYAGRSKPLNVNDFGKAMKPAAKVYGHEYITRKVKGVTQTNAITTDDCDAFL

SEQ ID NO: 15 - DNA, 1752 bp, Artificial Sequence
  PICI primase-helicase
atgaaactggcaccgaacgtaaaacagcagtcacgcggcataaaacacaaagaaacagaagtcattatttttgcgggtagtgatgcctggtcacacgcaaaacaatggcaggaacatgacgcgcgtatggccggagataatgagcctcctgtgtggcttggggagcagcagttatccgaactggataagctgcaaattgtgccggaaggcagaaaatccgtgcgcatattcagggccggatatcttgcgccagtaatgataaaggcgattggtcagaagctggcggcggcaggcgtacaggatgcaaatttttaccctgatggtatgcacggtcagaaggtggagaactggcgcgaatatctggcccgtgagcgccagaatctttctgatggtctggtcattgagcttccggtaaagcaaaaggcgcaactttcgcagatggcggacagtgagcgcgcgcagctgcttgccgatcgctttgatggcgtttgcgtacatcctgaaagtgaaatcgttcacgtatggtgcggcggggtatggtgtccggtcagcacaatggagctgagccgcgaaatggtggcgatctattcagagcacagggccactttcagcaagcgcgtaatcaataacgccgtggaagcgttaaaagttattgccgaaccaatgggcgagccgtccggcgatttgctgccgttcgccaatggtgcgcttgacctgaaaacgggggaattttccccgcacacgccggagaactggatcaccacgcacaacggcattgagtacacgccaccagcacccggggagaacatccgcgataacgcgccaaactttcataaatggcttgagcacgcagccggaaaagacccgcgcaagatgatgcgtatatgtgccgcgctgtacatgattatggcgaaccggtacgactggcagatgtttattgaggccaccggagacggcgggagcggtaaaagtacattcacacacatagccagccttctggcagggaaacaaaacacggtaagcgctgaaatgacatcgcttgatgatgctggtgggcgtgcgcaggttgtcgggagtcgtcttatcgtcctggcagaccagccgaaatatacaggcgaaggaacgggcatcaagaaaatcacgggcggcgaccccgtggaaattaacccgaaatatgaaaagcgttttacggcggtaatcagggcggtggtgctggcaaccaataacaatccgatgatattcaccgaacgggccggaggtgtggcacgtcgtcgggtgatattccggttcgataacatcgtaagcgaggcagaaaaagacagggagctaccggaaaagatcgcggctgaaatccctgtcattatccgccgcttgctggcgaactttgccgaccctgaaaaggcacgggctttactcattgaacagcgtgacggtgatgaagcactggcaataaagcaacagacggatccggttattgagttttgccagttcctgaattttctggaggaagcacgcggcctgatgatgggcggcggtggcgattcagtgaagtacacgaccagaaacagcctttaccgcgtctatctggcgtttatggcgtacgcaggcaggagcaaaccgctaaacgtaaatgactttggcaaggctatgaagccagccgcgaaagtttacggacatgaatatattacgcggaaagttaaaggagtaacgcagactaacgcaataacaacagacgattgcgacgcgttttta

SEQ ID NO: 16 - protein, 22 aa, Artificial Sequence
  Ro60 B cell epitope
TKYKQRNGWSHKDLLRLSHLKP

SEQ ID NO: 17 - protein, 20 aa, Artificial Sequence
  Ro60 T cell epitope (aa 316-335)
KARIHPFHILIALETYKTGH

SEQ ID NO: 18 - protein, 15 aa, Artificial Sequence
  Ro60 T cell epitope (aa 369-383)
KRFLAAVDVSASMNQ

SEQ ID NO: 19 - protein, 8 aa, Artificial Sequence
  candidate mimic peptide
AAAKHLTP

SEQ ID NO: 20 - protein, 9 aa, Artificial Sequence
  candidate mimic peptide
AACEAAVGL

SEQ ID NO: 21 - protein, 9 aa, Artificial Sequence
  candidate mimic peptide
AAGMNAAVR

SEQ ID NO: 22 - protein, 10 aa, Artificial Sequence
  candidate mimic peptide
AAHGNSLRGI

SEQ ID NO: 23 - protein, 10 aa, Artificial Sequence
  candidate mimic peptide
AALGSDTGGS

SEQ ID NO: 24 - protein, 11 aa, Artificial Sequence
  candidate mimic peptide
AAPFGGVKQSG

SEQ ID NO: 25 - protein, 9 aa, Artificial Sequence
  candidate mimic peptide
AAPGSKTTQ

SEQ ID NO: 26 - protein, 9 aa, Artificial Sequence
  candidate mimic peptide
AAPGTIRGD

SEQ ID NO: 27 - protein, 10 aa, Artificial Sequence
  candidate mimic peptide
AAPGTIRGDF

SEQ ID NO: 28 - protein, 9 aa, Artificial Sequence
  candidate mimic peptide
AAVEMRDNP

SEQ ID NO: 29 - protein, 10 aa, Artificial Sequence
  candidate mimic peptide
AAVPSGASTG

SEQ ID NO: 30 - protein, 9 aa, Artificial Sequence
  candidate mimic peptide
ACGTSYHAG

SEQ ID NO: 31 - protein, 9 aa, Artificial Sequence
  candidate mimic peptide
ADFIGKQAL

SEQ ID NO: 32 - protein, 9 aa, Artificial Sequence
  candidate mimic peptide
ADIGWITGH

SEQ ID NO: 33 - protein, 10 aa, Artificial Sequence
  candidate mimic peptide
ADIITPNQFE

SEQ ID NO: 34 - protein, 14 aa, Artificial Sequence
  candidate mimic peptide
ADIVTTTTHKTLRG

SEQ ID NO: 35 - protein, 9 aa, Artificial Sequence
  candidate mimic peptide
ADVGLVGFP

SEQ ID NO: 36 - protein, 10 aa, Artificial Sequence
  candidate mimic peptide
ADVGLVGFPN

SEQ ID NO: 37 - protein, 14 aa, Artificial Sequence
  candidate mimic peptide
ADVGLVGFPNAGKS

SEQ ID NO: 38 - protein, 13 aa, Artificial Sequence
  candidate mimic peptide
ADYLVVNVSSPNT

SEQ ID NO: 39 - protein, 10 aa, Artificial Sequence
  candidate mimic peptide
AEAYDVLSDP

SEQ ID NO: 40 - protein, 9 aa, Artificial Sequence
  candidate mimic peptide
AEDYHQQYL

SEQ ID NO: 41 - protein, 9 aa, Artificial Sequence
  candidate mimic peptide
AEIETDKAT

SEQ ID NO: 42 - protein, 11 aa, Artificial Sequence
  candidate mimic peptide
AESGWDFSSRW

SEQ ID NO: 43 - protein, 10 aa, Artificial Sequence
  candidate mimic peptide
AESWDNVGLL

SEQ ID NO: 44 - protein, 10 aa, Artificial Sequence
  candidate mimic peptide
AETEAQRRQA

SEQ ID NO: 45 - protein, 11 aa, Artificial Sequence
  candidate mimic peptide
AFDRILASRMG

SEQ ID NO: 46 - protein, 12 aa, Artificial Sequence
  candidate mimic peptide
AFDRILASRMGV

SEQ ID NO: 47 - protein, 9 aa, Artificial Sequence
  candidate mimic peptide
AFGFMTRVA

SEQ ID NO: 48 - protein, 10 aa, Artificial Sequence
  candidate mimic peptide
AFGFMTRVAL

SEQ ID NO: 49 - protein, 9 aa, Artificial Sequence
  candidate mimic peptide
AFLTVSGQL

SEQ ID NO: 50 - protein, 15 aa, Artificial Sequence
  candidate mimic peptide
AFMLPVATPPNAIVF

SEQ ID NO: 51 - protein, 14 aa, Artificial Sequence
  candidate mimic peptide
AGAESGWDFSSRWL

SEQ ID NO: 52 - protein, 14 aa, Artificial Sequence
  candidate mimic peptide
AGAMENWGLVTYRE

SEQ ID NO: 53 - protein, 9 aa, Artificial Sequence
  candidate mimic peptide
AGASLVQLY

SEQ ID NO: 54 - protein, 10 aa, Artificial Sequence
  candidate mimic peptide
AGASLVQLYT

SEQ ID NO: 55 - protein, 9 aa, Artificial Sequence
  candidate mimic peptide
AGDGTTTAT

SEQ ID NO: 56 - protein, 11 aa, Artificial Sequence
  candidate mimic peptide
AGDGTTTATVL

SEQ ID NO: 57 - protein, 12 aa, Artificial Sequence
  candidate mimic peptide
AGDGTTTATVLA

SEQ ID NO: 58 - protein, 9 aa, Artificial Sequence
  candidate mimic peptide
AGEFTRRAF

SEQ ID NO: 59 - protein, 9 aa, Artificial Sequence
  candidate mimic peptide
AGFSGHGFK

SEQ ID NO: 60 - protein, 9 aa, Artificial Sequence
  candidate mimic peptide
AGGQGTRLG

SEQ ID NO: 61 - protein, 9 aa, Artificial Sequence
  candidate mimic peptide
AGGRYDGLV

SEQ ID NO: 62 - protein, 10 aa, Artificial Sequence
  candidate mimic peptide
AGGRYDGLVG

SEQ ID NO: 63 - protein, 11 aa, Artificial Sequence
  candidate mimic peptide
AGGVTVSYFEW

SEQ ID NO: 64 - protein, 12 aa, Artificial Sequence
  candidate mimic peptide
AGIMITASHNPK

SEQ ID NO: 65 - protein, 14 aa, Artificial Sequence
  candidate mimic peptide
AGKLHTGRSRNDQV

SEQ ID NO: 66 - protein, 16 aa, Artificial Sequence
  candidate mimic peptide
AGLAVRDVSELTGFPE

SEQ ID NO: 67 - protein, 9 aa, Artificial Sequence
  candidate mimic peptide
AGLKEGDYI

SEQ ID NO: 68 - protein, 20 aa, Artificial Sequence
  candidate mimic peptide
AGNVVTGEMVEELILSGADI

SEQ ID NO: 69 - protein, 9 aa, Artificial Sequence
  candidate mimic peptide
AGTIAGLNV

SEQ ID NO: 70 - protein, 10 aa, Artificial Sequence
  candidate mimic peptide
AGVMITASHN

SEQ ID NO: 71 - protein, 9 aa, Artificial Sequence
  candidate mimic peptide
AGVPRKPGM

SEQ ID NO: 72 - protein, 9 aa, Artificial Sequence
  candidate mimic peptide
AGVTVVIVR

SEQ ID NO: 73 - protein, 12 aa, Artificial Sequence
  candidate mimic peptide
AGVTVVIVRDDL

SEQ ID NO: 74 - protein, 15 aa, Artificial Sequence
  candidate mimic peptide
AGYITPVPGGVGPMT

SEQ ID NO: 75 - protein, 9 aa, Artificial Sequence
  candidate mimic peptide
AHGNSLRGI

SEQ ID NO: 76 - protein, 9 aa, Artificial Sequence
  candidate mimic peptide
AHGTNPASA

SEQ ID NO: 77 - protein, 13 aa, Artificial Sequence
  candidate mimic peptide
AHIDAGKTTTTER

SEQ ID NO: 78 - protein, 15 aa, Artificial Sequence
  candidate mimic peptide
AHIDAGKTTTTERIL

SEQ ID NO: 79 - protein, 11 aa, Artificial Sequence
  candidate mimic peptide
AHLGHVFPDGP

SEQ ID NO: 80 - protein, 10 aa, Artificial Sequence
  candidate mimic peptide
AHVDHGKTTL

SEQ ID NO: 81 - protein, 9 aa, Artificial Sequence
  candidate mimic peptide
AIILATAGL

SEQ ID NO: 82 - protein, 14 aa, Artificial Sequence
  candidate mimic peptide
AIILATAGLQRMGW

SEQ ID NO: 83 - protein, 9 aa, Artificial Sequence
  candidate mimic peptide
AIKWNFTKF

SEQ ID NO: 84 - protein, 10 aa, Artificial Sequence
  candidate mimic peptide
AIVNAANSSL

SEQ ID NO: 85 - protein, 9 aa, Artificial Sequence
  candidate mimic peptide
AIYDTMQYI

SEQ ID NO: 86 - protein, 9 aa, Artificial Sequence
  candidate mimic peptide
AKALALGAS

SEQ ID NO: 87 - protein, 11 aa, Artificial Sequence
  candidate mimic peptide
AKEMHVGHLRS

SEQ ID NO: 88 - protein, 15 aa, Artificial Sequence
  candidate mimic peptide
AKEMHVGHLRSTIIG

SEQ ID NO: 89 - protein, 16 aa, Artificial Sequence
  candidate mimic peptide
AKKVLSVAVYNHYKRI

SEQ ID NO: 90 - protein, 10 aa, Artificial Sequence
  candidate mimic peptide
AKNTYGTGCF

SEQ ID NO: 91 - protein, 12 aa, Artificial Sequence
  candidate mimic peptide
AKNTYGTGCFLL

SEQ ID NO: 92 - protein, 9 aa, Artificial Sequence
  candidate mimic peptide
AKRLCPQLI

SEQ ID NO: 93 - protein, 9 aa, Artificial Sequence
  candidate mimic peptide
ALAAGNCVV

SEQ ID NO: 94 - protein, 15 aa, Artificial Sequence
  candidate mimic peptide
ALAAGNCVVLKPSEI

SEQ ID NO: 95 - protein, 9 aa, Artificial Sequence
  candidate mimic peptide
ALAAIFIAQ

SEQ ID NO: 96 - protein, 9 aa, Artificial Sequence
  candidate mimic peptide
ALEKIRAGA

SEQ ID NO: 97 - protein, 9 aa, Artificial Sequence
  candidate mimic peptide
ALEYGLPPT

SEQ ID NO: 98 - protein, 11 aa, Artificial Sequence
  candidate mimic peptide
ALEYGLPPTAG

SEQ ID NO: 99 - protein, 10 aa, Artificial Sequence
  candidate mimic peptide
ALFGTIDSWL

SEQ ID NO: 100 - protein, 9 aa, Artificial Sequence
  candidate mimic peptide
ALGSDTGGS

SEQ ID NO: 101 - protein, 9 aa, Artificial Sequence
  candidate mimic peptide
ALKAADVGI

SEQ ID NO: 102 - protein, 10 aa, Artificial Sequence
  candidate mimic peptide
ALKPMNCPGH

SEQ ID NO: 103 - protein, 9 aa, Artificial Sequence
  candidate mimic peptide
ALKYHPDKN

SEQ ID NO: 104 - protein, 9 aa, Artificial Sequence
  candidate mimic peptide
ALQTREQHI

SEQ ID NO: 105 - protein, 11 aa, Artificial Sequence
  candidate mimic peptide
ALQTREQHIRR

SEQ ID NO: 106 - protein, 9 aa, Artificial Sequence
  candidate mimic peptide
ALREAQEEV

SEQ ID NO: 107 - protein, 9 aa, Artificial Sequence
  candidate mimic peptide
ALRNRSNTP

SEQ ID NO: 108 - protein, 10 aa, Artificial Sequence
  candidate mimic peptide
ALRNRSNTPI

SEQ ID NO: 109 - protein, 11 aa, Artificial Sequence
  candidate mimic peptide
ALVGPNGAGKS

SEQ ID NO: 110 - protein, 11 aa, Artificial Sequence
  candidate mimic peptide
ALVTGASGGIG

SEQ ID NO: 111 - protein, 11 aa, Artificial Sequence
  candidate mimic peptide
AMEGPTPVSAL

SEQ ID NO: 112 - protein, 10 aa, Artificial Sequence
  candidate mimic peptide
AMLACARIGA

SEQ ID NO: 113 - protein, 12 aa, Artificial Sequence
  candidate mimic peptide
AMLACARIGAVH

SEQ ID NO: 114 - protein, 11 aa, Artificial Sequence
  candidate mimic peptide
AMLTTFNEIDM

SEQ ID NO: 115 - protein, 9 aa, Artificial Sequence
  candidate mimic peptide
AMVGDGIND

SEQ ID NO: 116 - protein, 15 aa, Artificial Sequence
  candidate mimic peptide
ANASLLDEGTAAAEA

SEQ ID NO: 117 - protein, 12 aa, Artificial Sequence
  candidate mimic peptide
ANDPDADRLAVA

SEQ ID NO: 118 - protein, 9 aa, Artificial Sequence
  candidate mimic peptide
ANFAVYTAL

SEQ ID NO: 119 - protein, 10 aa, Artificial Sequence
  candidate mimic peptide
ANFLDVGGGA

SEQ ID NO: 120 - protein, 9 aa, Artificial Sequence
  candidate mimic peptide
ANGPTTPEA

SEQ ID NO: 121 - protein, 10 aa, Artificial Sequence
  candidate mimic peptide
ANGPTTPEAD

SEQ ID NO: 122 - protein, 9 aa, Artificial Sequence
  candidate mimic peptide
ANMDTVGTF

SEQ ID NO: 123 - protein, 12 aa, Artificial Sequence
  candidate mimic peptide
ANMDTVGTFEMA

SEQ ID NO: 124 - protein, 9 aa, Artificial Sequence
  candidate mimic peptide
APALACGNA

SEQ ID NO: 125 - protein, 15 aa, Artificial Sequence
  candidate mimic peptide
APGRVNLIGEHTDYN

SEQ ID NO: 126 - protein, 9 aa, Artificial Sequence
  candidate mimic peptide
APGTGTPEI

SEQ ID NO: 127 - protein, 14 aa, Artificial Sequence
  candidate mimic peptide
APIFHVNADDPEAV

SEQ ID NO: 128 - protein, 9 aa, Artificial Sequence
  candidate mimic peptide
APSDMMDGR

SEQ ID NO: 129 - protein, 9 aa, Artificial Sequence
  candidate mimic peptide
APSPTGFLH

SEQ ID NO: 130 - protein, 10 aa, Artificial Sequence
  candidate mimic peptide
APTGSGKTLA

SEQ ID NO: 131 - protein, 9 aa, Artificial Sequence
  candidate mimic peptide
APTRELAQQ

SEQ ID NO: 132 - protein, 9 aa, Artificial Sequence
  candidate mimic peptide
AQEALGDVV

SEQ ID NO: 133 - protein, 10 aa, Artificial Sequence
  candidate mimic peptide
AQLSGGQKQR

SEQ ID NO: 134 - protein, 11 aa, Artificial Sequence
  candidate mimic peptide
AQLSGGQKQRV

SEQ ID NO: 135 - protein, 10 aa, Artificial Sequence
  candidate mimic peptide
AQSIGEPGTQ

SEQ ID NO: 136 - protein, 9 aa, Artificial Sequence
  candidate mimic peptide
ARGLDYYTG

SEQ ID NO: 137 - protein, 11 aa, Artificial Sequence
  candidate mimic peptide
ARLNFSHGSHE

SEQ ID NO: 138 - protein, 9 aa, Artificial Sequence
  candidate mimic peptide
ARMTAMDNA

SEQ ID NO: 139 - protein, 9 aa, Artificial Sequence
  candidate mimic peptide
ARVYKQSDL

SEQ ID NO: 140 - protein, 15 aa, Artificial Sequence
  candidate mimic peptide
ASFITPVPGGVGPMT

SEQ ID NO: 141 - protein, 17 aa, Artificial Sequence
  candidate mimic peptide
ASFITPVPGGVGPMTVA

SEQ ID NO: 142 - protein, 20 aa, Artificial Sequence
  candidate mimic peptide
ASFITPVPGGVGPMTVAMLM

SEQ ID NO: 143 - protein, 10 aa, Artificial Sequence
  candidate mimic peptide
ASGAGGQHVN

SEQ ID NO: 144 - protein, 10 aa, Artificial Sequence
  candidate mimic peptide
ASGPLVRSSY

SEQ ID NO: 145 - protein, 9 aa, Artificial Sequence
  candidate mimic peptide
ASKNASEMI

SEQ ID NO: 146 - protein, 10 aa, Artificial Sequence
  candidate mimic peptide
ASKPLKGARI

SEQ ID NO: 147 - protein, 13 aa, Artificial Sequence
  candidate mimic peptide
ASLLDEGTAAAEA

SEQ ID NO: 148 - protein, 12 aa, Artificial Sequence
  candidate mimic peptide
ASLVHDDVIDDA

SEQ ID NO: 149 - protein, 10 aa, Artificial Sequence
  candidate mimic peptide
ATDIAARGLD

SEQ ID NO: 150 - protein, 9 aa, Artificial Sequence
  candidate mimic peptide
ATDPDADRL

SEQ ID NO: 151 - protein, 11 aa, Artificial Sequence
  candidate mimic peptide
ATDVAARGLDI

SEQ ID NO: 152 - protein, 9 aa, Artificial Sequence
  candidate mimic peptide
ATIAFGMGI

SEQ ID NO: 153 - protein, 11 aa, Artificial Sequence
  candidate mimic peptide
ATINYPFEKGP

SEQ ID NO: 154 - protein, 11 aa, Artificial Sequence
  candidate mimic peptide
ATIQVYEETSG

SEQ ID NO: 155 - protein, 10 aa, Artificial Sequence
  candidate mimic peptide
ATPKGYEPDA

SEQ ID NO: 156 - protein, 9 aa, Artificial Sequence
  candidate mimic peptide
ATSGDTGSA

SEQ ID NO: 157 - protein, 15 aa, Artificial Sequence
  candidate mimic peptide
ATVKGDVHDIGKNIV

SEQ ID NO: 158 - protein, 9 aa, Artificial Sequence
  candidate mimic peptide
ATVVQKLLD

SEQ ID NO: 159 - protein, 10 aa, Artificial Sequence
  candidate mimic peptide
ATWCGPCKMI

SEQ ID NO: 160 - protein, 9 aa, Artificial Sequence
  candidate mimic peptide
AVDTTGAGD

SEQ ID NO: 161 - protein, 9 aa, Artificial Sequence
  candidate mimic peptide
AVGIDLGTT

SEQ ID NO: 162 - protein, 12 aa, Artificial Sequence
  candidate mimic peptide
AVGKIVMEAAAK

SEQ ID NO: 163 - protein, 10 aa, Artificial Sequence
  candidate mimic peptide
AVGQGALGVE

SEQ ID NO: 164 - protein, 9 aa, Artificial Sequence
  candidate mimic peptide
AVGSDADIV

SEQ ID NO: 165 - protein, 15 aa, Artificial Sequence
  candidate mimic peptide
AVIHFAGLKAVGESV

SEQ ID NO: 166 - protein, 9 aa, Artificial Sequence
  candidate mimic peptide
AVITVPAYF

SEQ ID NO: 167 - protein, 11 aa, Artificial Sequence
  candidate mimic peptide
AVITVPAYFND

SEQ ID NO: 168 - protein, 14 aa, Artificial Sequence
  candidate mimic peptide
AVITVPAYFNDSQR

SEQ ID NO: 169 - protein, 21 aa, Artificial Sequence
  candidate mimic peptide
AVITVPAYFNDSQRQATKDAG

SEQ ID NO: 170 - protein, 10 aa, Artificial Sequence
  candidate mimic peptide
AWSLLDNFEW

SEQ ID NO: 171 - protein, 10 aa, Artificial Sequence
  candidate mimic peptide
AWTTTPWTLP

SEQ ID NO: 172 - protein, 12 aa, Artificial Sequence
  candidate mimic peptide
AWTTTPWTLPSN

SEQ ID NO: 173 - protein, 14 aa, Artificial Sequence
  candidate mimic peptide
AWTTTPWTLPSNLA

SEQ ID NO: 174 - protein, 9 aa, Artificial Sequence
  candidate mimic peptide
AYEIIKLKG

SEQ ID NO: 175 - protein, 9 aa, Artificial Sequence
  candidate mimic peptide
AYEPVWAIG

SEQ ID NO: 176 - protein, 11 aa, Artificial Sequence
  candidate mimic peptide
AYEPVWAIGTG

SEQ ID NO: 177 - protein, 12 aa, Artificial Sequence
  candidate mimic peptide
AYEPVWAIGTGK

SEQ ID NO: 178 - protein, 14 aa, Artificial Sequence
  candidate mimic peptide
AYEPVWAIGTGKTA

SEQ ID NO: 179 - protein, 15 aa, Artificial Sequence
  candidate mimic peptide
AYEPVWAIGTGKTAT

SEQ ID NO: 180 - protein, 16 aa, Artificial Sequence
  candidate mimic peptide
AYEPVWAIGTGKTATP

SEQ ID NO: 181 - protein, 9 aa, Artificial Sequence
  candidate mimic peptide
AYEVLSDPQ

SEQ ID NO: 182 - protein, 9 aa, Artificial Sequence
  candidate mimic peptide
AYNADFDGD

SEQ ID NO: 183 - protein, 9 aa, Artificial Sequence
  candidate mimic peptide
AYSGGLDTS

SEQ ID NO: 184 - protein, 11 aa, Artificial Sequence
  candidate mimic peptide
CAAPGGKTTHI

SEQ ID NO: 185 - protein, 9 aa, Artificial Sequence
  candidate mimic peptide
CEAHLGHVF

SEQ ID NO: 186 - protein, 10 aa, Artificial Sequence
  candidate mimic peptide
CEHHLVPFVG

SEQ ID NO: 187 - protein, 9 aa, Artificial Sequence
  candidate mimic peptide
CETDFVSRN

SEQ ID NO: 188 - protein, 9 aa, Artificial Sequence
  candidate mimic peptide
CGNTVVVKP

SEQ ID NO: 189 - protein, 9 aa, Artificial Sequence
  candidate mimic peptide
CGSGVTACH

SEQ ID NO: 190 - protein, 13 aa, Artificial Sequence
  candidate mimic peptide
CIFEYVYFARPDS

SEQ ID NO: 191 - protein, 12 aa, Artificial Sequence
  candidate mimic peptide
CIGEKLDEREAG

SEQ ID NO: 192 - protein, 11 aa, Artificial Sequence
  candidate mimic peptide
CIRAGGKHNDL

SEQ ID NO: 193 - protein, 12 aa, Artificial Sequence
  candidate mimic peptide
CIRAGGKHNDLD

SEQ ID NO: 194 - protein, 10 aa, Artificial Sequence
  candidate mimic peptide
CLLTPGHTAG

SEQ ID NO: 195 - protein, 10 aa, Artificial Sequence
  candidate mimic peptide
CLNVGCIPSK

SEQ ID NO: 196 - protein, 13 aa, Artificial Sequence
  candidate mimic peptide
CLNVGCIPSKALL

SEQ ID NO: 197 - protein, 9 aa, Artificial Sequence
  candidate mimic peptide
CLSVNDAFV

SEQ ID NO: 198 - protein, 10 aa, Artificial Sequence
  candidate mimic peptide
CNALETLLIH

SEQ ID NO: 199 - protein, 10 aa, Artificial Sequence
  candidate mimic peptide
CNAYTELNDP

SEQ ID NO: 200 - protein, 10 aa, Artificial Sequence
  candidate mimic peptide
CNRLRITADG

SEQ ID NO: 201 - protein, 9 aa, Artificial Sequence
  candidate mimic peptide
CPVDAIVEG

SEQ ID NO: 202 - protein, 15 aa, Artificial Sequence
  candidate mimic peptide
CPWGKGRPGWHIECS

SEQ ID NO: 203 - protein, 9 aa, Artificial Sequence
  candidate mimic peptide
CRMCLVEIE

SEQ ID NO: 204 - protein, 11 aa, Artificial Sequence
  candidate mimic peptide
DADLINAGKET

SEQ ID NO: 205 - protein, 9 aa, Artificial Sequence
  candidate mimic peptide
DAFGLPAEN

SEQ ID NO: 206 - protein, 9 aa, Artificial Sequence
  candidate mimic peptide
DAFGTAHRA

SEQ ID NO: 207 - protein, 14 aa, Artificial Sequence
  candidate mimic peptide
DAGKTTTTERILYY

SEQ ID NO: 208 - protein, 9 aa, Artificial Sequence
  candidate mimic peptide
DAIVNAANS

SEQ ID NO: 209 - protein, 19 aa, Artificial Sequence
  candidate mimic peptide
DAIVNAANSSLLGGGGVDG

SEQ ID NO: 210 - protein, 10 aa, Artificial Sequence
  candidate mimic peptide
DAKINFDDNA

SEQ ID NO: 211 - protein, 9 aa, Artificial Sequence
  candidate mimic peptide
DALSSMANI

SEQ ID NO: 212 - protein, 12 aa, Artificial Sequence
  candidate mimic peptide
DALSSMANIAGY

SEQ ID NO: 213 - protein, 9 aa, Artificial Sequence
  candidate mimic peptide
DAPVSGGVG

SEQ ID NO: 214 - protein, 9 aa, Artificial Sequence
  candidate mimic peptide
DAQRQATKD

SEQ ID NO: 215 - protein, 11 aa, Artificial Sequence
  candidate mimic peptide
DAQRQATKDAG

SEQ ID NO: 216 - protein, 16 aa, Artificial Sequence
  candidate mimic peptide
DAQRQATKDAGTIAGL

SEQ ID NO: 217 - protein, 14 aa, Artificial Sequence
  candidate mimic peptide
DAVGMSTVPEVIVA

SEQ ID NO: 218 - protein, 15 aa, Artificial Sequence
  candidate mimic peptide
DCPGHADYVKNMITG

SEQ ID NO: 219 - protein, 12 aa, Artificial Sequence
  candidate mimic peptide
DDITHPIPDLTG

SEQ ID NO: 220 - protein, 9 aa, Artificial Sequence
  candidate mimic peptide
DDLLATGGT

SEQ ID NO: 221 - protein, 10 aa, Artificial Sequence
  candidate mimic peptide
DDLLATGGTM

SEQ ID NO: 222 - protein, 11 aa, Artificial Sequence
  candidate mimic peptide
DDNEETIKKRL

SEQ ID NO: 223 - protein, 9 aa, Artificial Sequence
  candidate mimic peptide
DEELKKAYR

SEQ ID NO: 224 - protein, 9 aa, Artificial Sequence
  candidate mimic peptide
DEIKKAYRK

SEQ ID NO: 225 - protein, 10 aa, Artificial Sequence
  candidate mimic peptide
DEIKKAYRKM

SEQ ID NO: 226 - protein, 9 aa, Artificial Sequence
  candidate mimic peptide
DELGRGTAT

SEQ ID NO: 227 - protein, 12 aa, Artificial Sequence
  candidate mimic peptide
DELGRGTSTYDG

SEQ ID NO: 228 - protein, 10 aa, Artificial Sequence
  candidate mimic peptide
DEPTNHLDME

SEQ ID NO: 229 - protein, 9 aa, Artificial Sequence
  candidate mimic peptide
DEVQTGFGR

SEQ ID NO: 230 - protein, 10 aa, Artificial Sequence
  candidate mimic peptide
DEYVGLPRDH

SEQ ID NO: 231 - protein, 10 aa, Artificial Sequence
  candidate mimic peptide
DFALWKAAKP

SEQ ID NO: 232 - protein, 10 aa, Artificial Sequence
  candidate mimic peptide
DFALWKASKP

SEQ ID NO: 233 - protein, 13 aa, Artificial Sequence
  candidate mimic peptide
DFALWKASKPGEP

SEQ ID NO: 234 - protein, 9 aa, Artificial Sequence
  candidate mimic peptide
DFIKTSTGK

SEQ ID NO: 235 - protein, 9 aa, Artificial Sequence
  candidate mimic peptide
DFSGGWRMR

SEQ ID NO: 236 - protein, 9 aa, Artificial Sequence
  candidate mimic peptide
DFSSPNIAK

SEQ ID NO: 237 - protein, 9 aa, Artificial Sequence
  candidate mimic peptide
DFTFVCPTE

SEQ ID NO: 238 - protein, 10 aa, Artificial Sequence
  candidate mimic peptide
DFTFVCPTEI

SEQ ID NO: 239 - protein, 13 aa, Artificial Sequence
  candidate mimic peptide
DFTFVCPTEIIAF

SEQ ID NO: 240 - protein, 9 aa, Artificial Sequence
  candidate mimic peptide
DGAGKTSVL

SEQ ID NO: 241 - protein, 9 aa, Artificial Sequence
  candidate mimic peptide
DGEAGGITQ

SEQ ID NO: 242 - protein, 9 aa, Artificial Sequence
  candidate mimic peptide
DGGQWDMLV

SEQ ID NO: 243 - protein, 9 aa, Artificial Sequence
  candidate mimic peptide
DGHIAFNEP

SEQ ID NO: 244 - protein, 9 aa, Artificial Sequence
  candidate mimic peptide
DGHTASLFP

SEQ ID NO: 245 - protein, 10 aa, Artificial Sequence
  candidate mimic peptide
DGILVPGGFG

SEQ ID NO: 246 - protein, 9 aa, Artificial Sequence
  candidate mimic peptide
DGKLYGRGA

SEQ ID NO: 247 - protein, 12 aa, Artificial Sequence
  candidate mimic peptide
DGLGFGDNTKAA

SEQ ID NO: 248 - protein, 9 aa, Artificial Sequence
  candidate mimic peptide
DGPLDMRMD

SEQ ID NO: 249 - protein, 10 aa, Artificial Sequence
  candidate mimic peptide
DGPMPQTREH

SEQ ID NO: 250 - protein, 11 aa, Artificial Sequence
  candidate mimic peptide
DGTKFDSSLDR

SEQ ID NO: 251 - protein, 10 aa, Artificial Sequence
  candidate mimic peptide
DGVGTKLKIA

SEQ ID NO: 252 - protein, 9 aa, Artificial Sequence
  candidate mimic peptide
DGWDSEPFT

SEQ ID NO: 253 - protein, 10 aa, Artificial Sequence
  candidate mimic peptide
DHGKSTLADR

SEQ ID NO: 254 - protein, 11 aa, Artificial Sequence
  candidate mimic peptide
DHGKSTLADRL

SEQ ID NO: 255 - protein, 13 aa, Artificial Sequence
  candidate mimic peptide
DHGKSTLADRLLE

SEQ ID NO: 256 - protein, 10 aa, Artificial Sequence
  candidate mimic peptide
DHPDAFDNEL

SEQ ID NO: 257 - protein, 11 aa, Artificial Sequence
  candidate mimic peptide
DHYENPRNVGS

SEQ ID NO: 258 - protein, 14 aa, Artificial Sequence
  candidate mimic peptide
DHYENPRNVGSLDK

SEQ ID NO: 259 - protein, 9 aa, Artificial Sequence
  candidate mimic peptide
DIEMSFVDQ

SEQ ID NO: 260 - protein, 9 aa, Artificial Sequence
  candidate mimic peptide
DILVNNAGI

SEQ ID NO: 261 - protein, 9 aa, Artificial Sequence
  candidate mimic peptide
DILVNNAGV

SEQ ID NO: 262 - protein, 9 aa, Artificial Sequence
  candidate mimic peptide
DISPQAPTH

SEQ ID NO: 263 - protein, 11 aa, Artificial Sequence
  candidate mimic peptide
DIYSRLLRERI

SEQ ID NO: 264 - protein, 9 aa, Artificial Sequence
  candidate mimic peptide
DKAGGYGIQ

SEQ ID NO: 265 - protein, 10 aa, Artificial Sequence
  candidate mimic peptide
DKHSTGGVGD

SEQ ID NO: 266 - protein, 9 aa, Artificial Sequence
  candidate mimic peptide
DKPDTRFGM

SEQ ID NO: 267 - protein, 10 aa, Artificial Sequence
  candidate mimic peptide
DKPRYLMGVG

SEQ ID NO: 268 - protein, 9 aa, Artificial Sequence
  candidate mimic peptide
DKTGTITHG

SEQ ID NO: 269 - protein, 11 aa, Artificial Sequence
  candidate mimic peptide
DLAIDGADEVD

SEQ ID NO: 270 - protein, 10 aa, Artificial Sequence
  candidate mimic peptide
DLEFVQFHPT

SEQ ID NO: 271 - protein, 9 aa, Artificial Sequence
  candidate mimic peptide
DLIIPRGSS

SEQ ID NO: 272 - protein, 9 aa, Artificial Sequence
  candidate mimic peptide
DLIVSNPPY

SEQ ID NO: 273 - protein, 10 aa, Artificial Sequence
  candidate mimic peptide
DLIVSNPPYV

SEQ ID NO: 274 - protein, 10 aa, Artificial Sequence
  candidate mimic peptide
DLKKAYRRLA

SEQ ID NO: 275 - protein, 9 aa, Artificial Sequence
  candidate mimic peptide
DLNRAGVGL

SEQ ID NO: 276 - protein, 9 aa, Artificial Sequence
  candidate mimic peptide
DLPLNVSRE

SEQ ID NO: 277 - protein, 10 aa, Artificial Sequence
  candidate mimic peptide
DLQEDKEAVF

SEQ ID NO: 278 - protein, 10 aa, Artificial Sequence
  candidate mimic peptide
DLRLNEPRYA

SEQ ID NO: 279 - protein, 9 aa, Artificial Sequence
  candidate mimic peptide
DLTDEEKQE

SEQ ID NO: 280 - protein, 9 aa, Artificial Sequence
  candidate mimic peptide
DLTHNPEFT

SEQ ID NO: 281 - protein, 10 aa, Artificial Sequence
  candidate mimic peptide
DLTHNPEFTT

SEQ ID NO: 282 - protein, 9 aa, Artificial Sequence
  candidate mimic peptide
DLTVPFARY

SEQ ID NO: 283 - protein, 11 aa, Artificial Sequence
  candidate mimic peptide
DLVGNNTPIFF

SEQ ID NO: 284 - protein, 12 aa, Artificial Sequence
  candidate mimic peptide
DLVGNNTPIFFI

SEQ ID NO: 285 - protein, 19 aa, Artificial Sequence
  candidate mimic peptide
DNFWEMGDTGPCGPCSEIH

SEQ ID NO: 286 - protein, 9 aa, Artificial Sequence
  candidate mimic peptide
DNHLILVDL

SEQ ID NO: 287 - protein, 11 aa, Artificial Sequence
  candidate mimic peptide
DNHLILVDLRS

SEQ ID NO: 288 - protein, 9 aa, Artificial Sequence
  candidate mimic peptide
DPLDGSSNI

SEQ ID NO: 289 - protein, 10 aa, Artificial Sequence
  candidate mimic peptide
DPLDGSSNID

SEQ ID NO: 290 - protein, 9 aa, Artificial Sequence
  candidate mimic peptide
DPSIFTVLT

SEQ ID NO: 291 - protein, 15 aa, Artificial Sequence
  candidate mimic peptide
DPTLLFANAGMNQFK

SEQ ID NO: 292 - protein, 9 aa, Artificial Sequence
  candidate mimic peptide
DQISDAVLD

SEQ ID NO: 293 - protein, 10 aa, Artificial Sequence
  candidate mimic peptide
DQISDAVLDA

SEQ ID NO: 294 - protein, 9 aa, Artificial Sequence
  candidate mimic peptide
DRILASRMG

SEQ ID NO: 295 - protein, 10 aa, Artificial Sequence
  candidate mimic peptide
DRQPEFTQID

SEQ ID NO: 296 - protein, 12 aa, Artificial Sequence
  candidate mimic peptide
DRQPEFTQIDIE

SEQ ID NO: 297 - protein, 15 aa, Artificial Sequence
  candidate mimic peptide
DRQPEFTQIDIEMSF

SEQ ID NO: 298 - protein, 16 aa, Artificial Sequence
  candidate mimic peptide
DRQPEFTQIDIEMSFV

SEQ ID NO: 299 - protein, 9 aa, Artificial Sequence
  candidate mimic peptide
DRTGTGTLS

SEQ ID NO: 300 - protein, 12 aa, Artificial Sequence
  candidate mimic peptide
DRTGTGTLSVFG

SEQ ID NO: 301 - protein, 10 aa, Artificial Sequence
  candidate mimic peptide
DSGGARIQEG

SEQ ID NO: 302 - protein, 10 aa, Artificial Sequence
  candidate mimic peptide
DSKPGTIRGD

SEQ ID NO: 303 - protein, 9 aa, Artificial Sequence
  candidate mimic peptide
DSRGNPTVE

SEQ ID NO: 304 - protein, 10 aa, Artificial Sequence
  candidate mimic peptide
DSRGNPTVEV

SEQ ID NO: 305 - protein, 11 aa, Artificial Sequence
  candidate mimic peptide
DSRGNPTVEVD

SEQ ID NO: 306 - protein, 10 aa, Artificial Sequence
  candidate mimic peptide
DTCQGDSGGP

SEQ ID NO: 307 - protein, 9 aa, Artificial Sequence
  candidate mimic peptide
DTGMGLERL

SEQ ID NO: 308 - protein, 9 aa, Artificial Sequence
  candidate mimic peptide
DTRGIFRVH

SEQ ID NO: 309 - protein, 11 aa, Artificial Sequence
  candidate mimic peptide
DTRGIFRVHQF

SEQ ID NO: 310 - protein, 9 aa, Artificial Sequence
  candidate mimic peptide
DVANAVLDG

SEQ ID NO: 311 - protein, 9 aa, Artificial Sequence
  candidate mimic peptide
DVAVIGVPD

SEQ ID NO: 312 - protein, 9 aa, Artificial Sequence
  candidate mimic peptide
DVFCEKGVF

SEQ ID NO: 313 - protein, 9 aa, Artificial Sequence
  candidate mimic peptide
DVGCGSGIL

SEQ ID NO: 314 - protein, 10 aa, Artificial Sequence
  candidate mimic peptide
DVGCGTGILS

SEQ ID NO: 315 - protein, 9 aa, Artificial Sequence
  candidate mimic peptide
DVINAAEKL

SEQ ID NO: 316 - protein, 13 aa, Artificial Sequence
  candidate mimic peptide
DVKVVILGQDPYH

SEQ ID NO: 317 - protein, 14 aa, Artificial Sequence
  candidate mimic peptide
DVKVVILGQDPYHG

SEQ ID NO: 318 - protein, 15 aa, Artificial Sequence
  candidate mimic peptide
DVKVVILGQDPYHGP

SEQ ID NO: 319 - protein, 21 aa, Artificial Sequence
  candidate mimic peptide
DVKVVILGQDPYHGPNQAHGL

SEQ ID NO: 320 - protein, 9 aa, Artificial Sequence
  candidate mimic peptide
DVLDTWFSS

SEQ ID NO: 321 - protein, 11 aa, Artificial Sequence
  candidate mimic peptide
DVLDTWFSSGL

SEQ ID NO: 322 - protein, 10 aa, Artificial Sequence
  candidate mimic peptide
DVLVATDVAS

SEQ ID NO: 323 - protein, 9 aa, Artificial Sequence
  candidate mimic peptide
DVLVNNAGI

SEQ ID NO: 324 - protein, 10 aa, Artificial Sequence
  candidate mimic peptide
DVLVNNAGIA

SEQ ID NO: 325 - protein, 12 aa, Artificial Sequence
  candidate mimic peptide
DVMDGHFVPNIT

SEQ ID NO: 326 - protein, 10 aa, Artificial Sequence
  candidate mimic peptide
DVSELTGFPE

SEQ ID NO: 327 - protein, 15 aa, Artificial Sequence
  candidate mimic peptide
DVVIVGAGPAGLSAA

SEQ ID NO: 328 - protein, 9 aa, Artificial Sequence
  candidate mimic peptide
DVWEHAYYL

SEQ ID NO: 329 - protein, 13 aa, Artificial Sequence
  candidate mimic peptide
DVWEHAYYLQYKN

SEQ ID NO: 330 - protein, 14 aa, Artificial Sequence
  candidate mimic peptide
DVYVNDAFGTAHRA

SEQ ID NO: 331 - protein, 15 aa, Artificial Sequence
  candidate mimic peptide
DVYVNDAFGTAHRAH

SEQ ID NO: 332 - protein, 9 aa, Artificial Sequence
  candidate mimic peptide
DWRTKKPVV

SEQ ID NO: 333 - protein, 9 aa, Artificial Sequence
  candidate mimic peptide
DYGPFGFLD

SEQ ID NO: 334 - protein, 9 aa, Artificial Sequence
  candidate mimic peptide
DYYEILGVS

SEQ ID NO: 335 - protein, 9 aa, Artificial Sequence
  candidate mimic peptide
DYYEVLGLQ

SEQ ID NO: 336 - protein, 10 aa, Artificial Sequence
  candidate mimic peptide
EAAPGTIRGD

SEQ ID NO: 337 - protein, 11 aa, Artificial Sequence
  candidate mimic peptide
EAAPGTIRGDF

SEQ ID NO: 338 - protein, 13 aa, Artificial Sequence
  candidate mimic peptide
EAGDGTTTATVLA

SEQ ID NO: 339 - protein, 10 aa, Artificial Sequence
  candidate mimic peptide
EAIKRDFGSF

SEQ ID NO: 340 - protein, 10 aa, Artificial Sequence
  candidate mimic peptide
EALREVSAAR

SEQ ID NO: 341 - protein, 17 aa, Artificial Sequence
  candidate mimic peptide
EASGTGNMKFMLNGALT

SEQ ID NO: 342 - protein, 9 aa, Artificial Sequence
  candidate mimic peptide
EAYEVLSDA

SEQ ID NO: 343 - protein, 9 aa, Artificial Sequence
  candidate mimic peptide
EAYEVLSDE

SEQ ID NO: 344 - protein, 9 aa, Artificial Sequence
  candidate mimic peptide
EAYEVLSDP

SEQ ID NO: 345 - protein, 9 aa, Artificial Sequence
  candidate mimic peptide
EAYEVLSDS

SEQ ID NO: 346 - protein, 9 aa, Artificial Sequence
  candidate mimic peptide
ECKIGIMPG

SEQ ID NO: 347 - protein, 9 aa, Artificial Sequence
  candidate mimic peptide
EDPVTGSAH

SEQ ID NO: 348 - protein, 13 aa, Artificial Sequence
  candidate mimic peptide
EDQIYRIDHYLGK

SEQ ID NO: 349 - protein, 9 aa, Artificial Sequence
  candidate mimic peptide
EDRIVKRFL

SEQ ID NO: 350 - protein, 9 aa, Artificial Sequence
  candidate mimic peptide
EDVKKRILE

SEQ ID NO: 351 - protein, 9 aa, Artificial Sequence
  candidate mimic peptide
EEARGDQCD

SEQ ID NO: 352 - protein, 10 aa, Artificial Sequence
  candidate mimic peptide
EEGDLGPVYG

SEQ ID NO: 353 - protein, 10 aa, Artificial Sequence
  candidate mimic peptide
EEHDQEGRVI

SEQ ID NO: 354 - protein, 10 aa, Artificial Sequence
  candidate mimic peptide
EEIFGPVLVV

SEQ ID NO: 355 - protein, 9 aa, Artificial Sequence
  candidate mimic peptide
EEIKKAYRK

SEQ ID NO: 356 - protein, 9 aa, Artificial Sequence
  candidate mimic peptide
EEMRQSLRI

SEQ ID NO: 357 - protein, 10 aa, Artificial Sequence
  candidate mimic peptide
EEMRQSLRII

SEQ ID NO: 358 - protein, 13 aa, Artificial Sequence
  candidate mimic peptide
EFTQIDIEMSFVD

SEQ ID NO: 359 - protein, 9 aa, Artificial Sequence
  candidate mimic peptide
EFYMAYADY

SEQ ID NO: 360 - protein, 12 aa, Artificial Sequence
  candidate mimic peptide
EGDSAFGFSGME

SEQ ID NO: 361 - protein, 10 aa, Artificial Sequence
  candidate mimic peptide
EGGGCSGFQY

SEQ ID NO: 362 - protein, 11 aa, Artificial Sequence
  candidate mimic peptide
EGGVHRVQRVP

SEQ ID NO: 363 - protein, 9 aa, Artificial Sequence
  candidate mimic peptide
EGHPDKICD

SEQ ID NO: 364 - protein, 13 aa, Artificial Sequence
  candidate mimic peptide
EGHPDKICDQISD

SEQ ID NO: 365 - protein, 14 aa, Artificial Sequence
  candidate mimic peptide
EGHPDKICDQISDA

SEQ ID NO: 366 - protein, 18 aa, Artificial Sequence
  candidate mimic peptide
EGHPDKICDQISDAVLDA

SEQ ID NO: 367 - protein, 11 aa, Artificial Sequence
  candidate mimic peptide
EGWLAEHMLIL

SEQ ID NO: 368 - protein, 9 aa, Artificial Sequence
  candidate mimic peptide
EGYNTVVGE

SEQ ID NO: 369 - protein, 11 aa, Artificial Sequence
  candidate mimic peptide
EGYPGKRYYGG

SEQ ID NO: 370 - protein, 9 aa, Artificial Sequence
  candidate mimic peptide
EIAGPGFIN

SEQ ID NO: 371 - protein, 11 aa, Artificial Sequence
  candidate mimic peptide
EIFLRELISNA

SEQ ID NO: 372 - protein, 14 aa, Artificial Sequence
  candidate mimic peptide
EIFLRELISNASDA

SEQ ID NO: 373 - protein, 9 aa, Artificial Sequence
  candidate mimic peptide
EIGGGSIRI

SEQ ID NO: 374 - protein, 9 aa, Artificial Sequence
  candidate mimic peptide
EIGVASTKA

SEQ ID NO: 375 - protein, 10 aa, Artificial Sequence
  candidate mimic peptide
EIKKAYRKLA

SEQ ID NO: 376 - protein, 10 aa, Artificial Sequence
  candidate mimic peptide
EKSPYLLQHA

SEQ ID NO: 377 - protein, 9 aa, Artificial Sequence
  candidate mimic peptide
ELGGKSPLI

SEQ ID NO: 378 - protein, 10 aa, Artificial Sequence
  candidate mimic peptide
ELGGKSPLII

SEQ ID NO: 379 - protein, 11 aa, Artificial Sequence
  candidate mimic peptide
ELGGKSPLIIF

SEQ ID NO: 380 - protein, 10 aa, Artificial Sequence
  candidate mimic peptide
ELIASENFAS

SEQ ID NO: 381 - protein, 12 aa, Artificial Sequence
  candidate mimic peptide
ELLGRVVDALGN

SEQ ID NO: 382 - protein, 11 aa, Artificial Sequence
  candidate mimic peptide
ELNRKVLADLA

SEQ ID NO: 383 - protein, 9 aa, Artificial Sequence
  candidate mimic peptide
EMNLSETAF

SEQ ID NO: 384 - protein, 9 aa, Artificial Sequence
  candidate mimic peptide
EMRQSLRII

SEQ ID NO: 385 - protein, 11 aa, Artificial Sequence
  candidate mimic peptide
ENGMDVFRVFD

SEQ ID NO: 386 - protein, 9 aa, Artificial Sequence
  candidate mimic peptide
ENIRRIAEV

SEQ ID NO: 387 - protein, 9 aa, Artificial Sequence
  candidate mimic peptide
ENLRVVDAS

SEQ ID NO: 388 - protein, 12 aa, Artificial Sequence
  candidate mimic peptide
ENYVHRIGRTGR

SEQ ID NO: 389 - protein, 9 aa, Artificial Sequence
  candidate mimic peptide
EPGAEEKFK

SEQ ID NO: 390 - protein, 9 aa, Artificial Sequence
  candidate mimic peptide
EPIGVCGQI

SEQ ID NO: 391 - protein, 9 aa, Artificial Sequence
  candidate mimic peptide
EPTSGNTGI

SEQ ID NO: 392 - protein, 12 aa, Artificial Sequence
  candidate mimic peptide
EPTSGNTGIGLA

SEQ ID NO: 393 - protein, 11 aa, Artificial Sequence
  candidate mimic peptide
ERAYDIYSRLL

SEQ ID NO: 394 - protein, 12 aa, Artificial Sequence
  candidate mimic peptide
ERAYDIYSRLLR

SEQ ID NO: 395 - protein, 12 aa, Artificial Sequence
  candidate mimic peptide
ERFSYYGMRAIL

SEQ ID NO: 396 - protein, 9 aa, Artificial Sequence
  candidate mimic peptide
ERGTFSHRH

SEQ ID NO: 397 - protein, 10 aa, Artificial Sequence
  candidate mimic peptide
ERIPERVVHA

SEQ ID NO: 398 - protein, 10 aa, Artificial Sequence
  candidate mimic peptide
ERKTGARGLR

SEQ ID NO: 399 - protein, 12 aa, Artificial Sequence
  candidate mimic peptide
ERKTGARGLRSI

SEQ ID NO: 400 - protein, 10 aa, Artificial Sequence
  candidate mimic peptide
ERLEFLGDAV

SEQ ID NO: 401 - protein, 11 aa, Artificial Sequence
  candidate mimic peptide
ESMLTGESVPV

SEQ ID NO: 402 - protein, 10 aa, Artificial Sequence
  candidate mimic peptide
ESVKAASELY

SEQ ID NO: 403 - protein, 13 aa, Artificial Sequence
  candidate mimic peptide
ESVKAASELYSPL

SEQ ID NO: 404 - protein, 12 aa, Artificial Sequence
  candidate mimic peptide
ESVRGKDVFIIQ

SEQ ID NO: 405 - protein, 10 aa, Artificial Sequence
  candidate mimic peptide
ETGGLSGKPL

SEQ ID NO: 406 - protein, 12 aa, Artificial Sequence
  candidate mimic peptide
ETLGGTCLNVGC

SEQ ID NO: 407 - protein, 9 aa, Artificial Sequence
  candidate mimic peptide
ETMLGDVAV

SEQ ID NO: 408 - protein, 13 aa, Artificial Sequence
  candidate mimic peptide
ETMLGDVAVAVHP

SEQ ID NO: 409 - protein, 12 aa, Artificial Sequence
  candidate mimic peptide
ETRYRQRYLDLI

SEQ ID NO: 410 - protein, 9 aa, Artificial Sequence
  candidate mimic peptide
ETVGVGQSE

SEQ ID NO: 411 - protein, 9 aa, Artificial Sequence
  candidate mimic peptide
ETYGCQMNV

SEQ ID NO: 412 - protein, 10 aa, Artificial Sequence
  candidate mimic peptide
EVAKLFADAG

SEQ ID NO: 413 - protein, 9 aa, Artificial Sequence
  candidate mimic peptide
EVEGLADLI

SEQ ID NO: 414 - protein, 11 aa, Artificial Sequence
  candidate mimic peptide
EVGPRDGLQNE

SEQ ID NO: 415 - protein, 9 aa, Artificial Sequence
  candidate mimic peptide
EVRGGGRKP

SEQ ID NO: 416 - protein, 10 aa, Artificial Sequence
  candidate mimic peptide
EVRGGGRKPW

SEQ ID NO: 417 - protein, 10 aa, Artificial Sequence
  candidate mimic peptide
EVTLLGQNVN

SEQ ID NO: 418 - protein, 11 aa, Artificial Sequence
  candidate mimic peptide
EVTLLGQNVNS

SEQ ID NO: 419 - protein, 10 aa, Artificial Sequence
  candidate mimic peptide
EWWNDLWLNE

SEQ ID NO: 420 - protein, 10 aa, Artificial Sequence
  candidate mimic peptide
EYCLGPTHEE

SEQ ID NO: 421 - protein, 11 aa, Artificial Sequence
  candidate mimic peptide
EYCLGPTHEEA

SEQ ID NO: 422 - protein, 9 aa, Artificial Sequence
  candidate mimic peptide
EYLARVVFD

SEQ ID NO: 423 - protein, 9 aa, Artificial Sequence
  candidate mimic peptide
EYRGYDSAG

SEQ ID NO: 424 - protein, 10 aa, Artificial Sequence
  candidate mimic peptide
EYSRSGNPTR

SEQ ID NO: 425 - protein, 9 aa, Artificial Sequence
  candidate mimic peptide
FALCGFANF

SEQ ID NO: 426 - protein, 12 aa, Artificial Sequence
  candidate mimic peptide
FALCGFANFSSI

SEQ ID NO: 427 - protein, 11 aa, Artificial Sequence
  candidate mimic peptide
FALKPMNCPGH

SEQ ID NO: 428 - protein, 9 aa, Artificial Sequence
  candidate mimic peptide
FANFSSIGI

SEQ ID NO: 429 - protein, 9 aa, Artificial Sequence
  candidate mimic peptide
FAPEVAWVT

SEQ ID NO: 430 - protein, 10 aa, Artificial Sequence
  candidate mimic peptide
FCAGADLKER

SEQ ID NO: 431 - protein, 11 aa, Artificial Sequence
  candidate mimic peptide
FCKEFNERTKD

SEQ ID NO: 432 - protein, 11 aa, Artificial Sequence
  candidate mimic peptide
FDPLDGSSNID

SEQ ID NO: 433 - protein, 13 aa, Artificial Sequence
  candidate mimic peptide
FDRERIPERVVHA

SEQ ID NO: 434 - protein, 15 aa, Artificial Sequence
  candidate mimic peptide
FDRERIPERVVHAKG

SEQ ID NO: 435 - protein, 11 aa, Artificial Sequence
  candidate mimic peptide
FDRILASRMGV

SEQ ID NO: 436 - protein, 11 aa, Artificial Sequence
  candidate mimic peptide
FDRILLDAPCS

SEQ ID NO: 437 - protein, 9 aa, Artificial Sequence
  candidate mimic peptide
FDTAPTGHT

SEQ ID NO: 438 - protein, 11 aa, Artificial Sequence
  candidate mimic peptide
FEYVYFARPDS

SEQ ID NO: 439 - protein, 15 aa, Artificial Sequence
  candidate mimic peptide
FFYPLDFTFVCPTEI

SEQ ID NO: 440 - protein, 9 aa, Artificial Sequence
  candidate mimic peptide
FGHPEVYIL

SEQ ID NO: 441 - protein, 12 aa, Artificial Sequence
  candidate mimic peptide
FGHPEVYILILP

SEQ ID NO: 442 - protein, 9 aa, Artificial Sequence
  candidate mimic peptide
FGICLGHQL

SEQ ID NO: 443 - protein, 11 aa, Artificial Sequence
  candidate mimic peptide
FGLGAEVGIST

SEQ ID NO: 444 - protein, 9 aa, Artificial Sequence
  candidate mimic peptide
FGLPAENAA

SEQ ID NO: 445 - protein, 11 aa, Artificial Sequence
  candidate mimic peptide
FGMGCFWGAER

SEQ ID NO: 446 - protein, 10 aa, Artificial Sequence
  candidate mimic peptide
FGMIPEFVGR

SEQ ID NO: 447 - protein, 9 aa, Artificial Sequence
  candidate mimic peptide
FGSFDKFKE

SEQ ID NO: 448 - protein, 13 aa, Artificial Sequence
  candidate mimic peptide
FGTGAVKITPAHD

SEQ ID NO: 449 - protein, 10 aa, Artificial Sequence
  candidate mimic peptide
FGTIDSWLIW

SEQ ID NO: 450 - protein, 9 aa, Artificial Sequence
  candidate mimic peptide
FGWDCHGLP

SEQ ID NO: 451 - protein, 10 aa, Artificial Sequence
  candidate mimic peptide
FHAIYWPAFL

SEQ ID NO: 452 - protein, 10 aa, Artificial Sequence
  candidate mimic peptide
FHSLEDRIVK

SEQ ID NO: 453 - protein, 12 aa, Artificial Sequence
  candidate mimic peptide
FHSLEDRIVKRF

SEQ ID NO: 454 - protein, 9 aa, Artificial Sequence
  candidate mimic peptide
FIAGADINM

SEQ ID NO: 455 - protein, 13 aa, Artificial Sequence
  candidate mimic peptide
FIGRSNVGKSSLI

SEQ ID NO: 456 - protein, 9 aa, Artificial Sequence
  candidate mimic peptide
FITHLHGDH

SEQ ID NO: 457 - protein, 13 aa, Artificial Sequence
  candidate mimic peptide
FITPVPGGVGPMT

SEQ ID NO: 458 - protein, 19 aa, Artificial Sequence
  candidate mimic peptide
FITPVPGGVGPMTVAMLMQ

SEQ ID NO: 459 - protein, 9 aa, Artificial Sequence
  candidate mimic peptide
FKQLLMVGG

SEQ ID NO: 460 - protein, 9 aa, Artificial Sequence
  candidate mimic peptide
FKQLYDKGL

SEQ ID NO: 461 - protein, 9 aa, Artificial Sequence
  candidate mimic peptide
FLKHIERTR

SEQ ID NO: 462 - protein, 12 aa, Artificial Sequence
  candidate mimic peptide
FLRELISNASDA

SEQ ID NO: 463 - protein, 9 aa, Artificial Sequence
  candidate mimic peptide
FLRHIERCR

SEQ ID NO: 464 - protein, 9 aa, Artificial Sequence
  candidate mimic peptide
FLSNGPGDP

SEQ ID NO: 465 - protein, 10 aa, Artificial Sequence
  candidate mimic peptide
FLSNGPGDPA

SEQ ID NO: 466 - protein, 10 aa, Artificial Sequence
  candidate mimic peptide
FLSQSGETAD

SEQ ID NO: 467 - protein, 9 aa, Artificial Sequence
  candidate mimic peptide
FLWVVDFPL

SEQ ID NO: 468 - protein, 9 aa, Artificial Sequence
  candidate mimic peptide
FMPVGTQAT

SEQ ID NO: 469 - protein, 10 aa, Artificial Sequence
  candidate mimic peptide
FMQKEIFEQP

SEQ ID NO: 470 - protein, 9 aa, Artificial Sequence
  candidate mimic peptide
FNDDIQGTA

SEQ ID NO: 471 - protein, 13 aa, Artificial Sequence
  candidate mimic peptide
FNDDIQGTASVAV

SEQ ID NO: 472 - protein, 11 aa, Artificial Sequence
  candidate mimic peptide
FPAGILQAPFY

SEQ ID NO: 473 - protein, 13 aa, Artificial Sequence
  candidate mimic peptide
FPGYTHLQRAQPI

SEQ ID NO: 474 - protein, 10 aa, Artificial Sequence
  candidate mimic peptide
FPHHENEIAQ

SEQ ID NO: 475 - protein, 9 aa, Artificial Sequence
  candidate mimic peptide
FPLLTTKRV

SEQ ID NO: 476 - protein, 13 aa, Artificial Sequence
  candidate mimic peptide
FPLVVWQTGSGTQ

SEQ ID NO: 477 - protein, 9 aa, Artificial Sequence
  candidate mimic peptide
FQALRIFVN

SEQ ID NO: 478 - protein, 9 aa, Artificial Sequence
  candidate mimic peptide
FRASPRQSD

SEQ ID NO: 479 - protein, 12 aa, Artificial Sequence
  candidate mimic peptide
FRASPRQSDVMI

SEQ ID NO: 480 - protein, 14 aa, Artificial Sequence
  candidate mimic peptide
FRPWTIRQYAGFST

SEQ ID NO: 481 - protein, 11 aa, Artificial Sequence
  candidate mimic peptide
FSMCEHHLVPF

SEQ ID NO: 482 - protein, 10 aa, Artificial Sequence
  candidate mimic peptide
FSMDGDIAPL

SEQ ID NO: 483 - protein, 10 aa, Artificial Sequence
  candidate mimic peptide
FTFGPTFRAE

SEQ ID NO: 484 - protein, 10 aa, Artificial Sequence
  candidate mimic peptide
FTSGATESNN

SEQ ID NO: 485 - protein, 9 aa, Artificial Sequence
  candidate mimic peptide
FTSGGTESN

SEQ ID NO: 486 - protein, 10 aa, Artificial Sequence
  candidate mimic peptide
FTSGGTESNN

SEQ ID NO: 487 - protein, 11 aa, Artificial Sequence
  candidate mimic peptide
FTTVVADTGDF

SEQ ID NO: 488 - protein, 11 aa, Artificial Sequence
  candidate mimic peptide
FVCLGNICRSP

SEQ ID NO: 489 - protein, 17 aa, Artificial Sequence
  candidate mimic peptide
FVPNDMQVGQTGKIVAP

SEQ ID NO: 490 - protein, 10 aa, Artificial Sequence
  candidate mimic peptide
FVVVGPEAPL

SEQ ID NO: 491 - protein, 11 aa, Artificial Sequence
  candidate mimic peptide
FYAAVEMRDNP

SEQ ID NO: 492 - protein, 18 aa, Artificial Sequence
  candidate mimic peptide
FYDGPPFATGLPHYGHIL

SEQ ID NO: 493 - protein, 9 aa, Artificial Sequence
  candidate mimic peptide
FYGPFRDAA

SEQ ID NO: 494 - protein, 11 aa, Artificial Sequence
  candidate mimic peptide
FYQASTSELYG

SEQ ID NO: 495 - protein, 9 aa, Artificial Sequence
  candidate mimic peptide
GACVNAPMV

SEQ ID NO: 496 - protein, 9 aa, Artificial Sequence
  candidate mimic peptide
GAFTGEISP

SEQ ID NO: 497 - protein, 11 aa, Artificial Sequence
  candidate mimic peptide
GAFTGEISPGM

SEQ ID NO: 498 - protein, 10 aa, Artificial Sequence
  candidate mimic peptide
GAFYGPKIDI

SEQ ID NO: 499 - protein, 12 aa, Artificial Sequence
  candidate mimic peptide
GAFYGPKIDIKI

SEQ ID NO: 500 - protein, 10 aa, Artificial Sequence
  candidate mimic peptide
GAGDQGLMFG

SEQ ID NO: 501 - protein, 12 aa, Artificial Sequence
  candidate mimic peptide
GAGDQGLMFGYA

SEQ ID NO: 502 - protein, 13 aa, Artificial Sequence
  candidate mimic peptide
GAGDQGLMFGYAT

SEQ ID NO: 503 - protein, 16 aa, Artificial Sequence
  candidate mimic peptide
GAGDQGLMFGYATDET

SEQ ID NO: 504 - protein, 10 aa, Artificial Sequence
  candidate mimic peptide
GAGGQHVNKT

SEQ ID NO: 505 - protein, 13 aa, Artificial Sequence
  candidate mimic peptide
GAGGQHVNKTDSA

SEQ ID NO: 506 - protein, 15 aa, Artificial Sequence
  candidate mimic peptide
GAGHFVKMVHNGIEY

SEQ ID NO: 507 - protein, 14 aa, Artificial Sequence
  candidate mimic peptide
GAGISTESGIPDYR

SEQ ID NO: 508 - protein, 9 aa, Artificial Sequence
  candidate mimic peptide
GAGKTTVGR

SEQ ID NO: 509 - protein, 9 aa, Artificial Sequence
  candidate mimic peptide
GAGVSAESG

SEQ ID NO: 510 - protein, 14 aa, Artificial Sequence
  candidate mimic peptide
GAGVSAESGVPTFR

SEQ ID NO: 511 - protein, 10 aa, Artificial Sequence
  candidate mimic peptide
GAHIYVCGDA

SEQ ID NO: 512 - protein, 12 aa, Artificial Sequence
  candidate mimic peptide
GAHTDSPCLRVK

SEQ ID NO: 513 - protein, 9 aa, Artificial Sequence
  candidate mimic peptide
GAHVNPAVT

SEQ ID NO: 514 - protein, 9 aa, Artificial Sequence
  candidate mimic peptide
GANAILGVS

SEQ ID NO: 515 - protein, 11 aa, Artificial Sequence
  candidate mimic peptide
GANAILGVSLA

SEQ ID NO: 516 - protein, 9 aa, Artificial Sequence
  candidate mimic peptide
GAPGSGKGT

SEQ ID NO: 517 - protein, 10 aa, Artificial Sequence
  candidate mimic peptide
GAPNAGKSTL

SEQ ID NO: 518 - protein, 9 aa, Artificial Sequence
  candidate mimic peptide
GAPPHGGIA

SEQ ID NO: 519 - protein, 11 aa, Artificial Sequence
  candidate mimic peptide
GAQWGDEGKGK

SEQ ID NO: 520 - protein, 14 aa, Artificial Sequence
  candidate mimic peptide
GAQWGDEGKGKVVD

SEQ ID NO: 521 - protein, 9 aa, Artificial Sequence
  candidate mimic peptide
GASGDLAPL

SEQ ID NO: 522 - protein, 11 aa, Artificial Sequence
  candidate mimic peptide
GASGDLAPLSH

SEQ ID NO: 523 - protein, 14 aa, Artificial Sequence
  candidate mimic peptide
GASGDLAPLSHLAL

SEQ ID NO: 524 - protein, 10 aa, Artificial Sequence
  candidate mimic peptide
GAVKITPAHD

SEQ ID NO: 525 - protein, 10 aa, Artificial Sequence
  candidate mimic peptide
GCCPGGTASN

SEQ ID NO: 526 - protein, 11 aa, Artificial Sequence
  candidate mimic peptide
GCFWGAERKFW

SEQ ID NO: 527 - protein, 9 aa, Artificial Sequence
  candidate mimic peptide
GCIPSKALL

SEQ ID NO: 528 - protein, 17 aa, Artificial Sequence
  candidate mimic peptide
GCMKGRTMYVIPFSMGP

SEQ ID NO: 529 - protein, 21 aa, Artificial Sequence
  candidate mimic peptide
GCMKGRTMYVIPFSMGPLGSP

SEQ ID NO: 530 - protein, 10 aa, Artificial Sequence
  candidate mimic peptide
GDADVMVAGG

SEQ ID NO: 531 - protein, 11 aa, Artificial Sequence
  candidate mimic peptide
GDADVMVAGGT

SEQ ID NO: 532 - protein, 9 aa, Artificial Sequence
  candidate mimic peptide
GDDEAMFID

SEQ ID NO: 533 - protein, 9 aa, Artificial Sequence
  candidate mimic peptide
GDGAANQGQ

SEQ ID NO: 534 - protein, 11 aa, Artificial Sequence
  candidate mimic peptide
GDGAFYGPKID

SEQ ID NO: 535 - protein, 12 aa, Artificial Sequence
  candidate mimic peptide
GDGAFYGPKIDI

SEQ ID NO: 536 - protein, 13 aa, Artificial Sequence
  candidate mimic peptide
GDGAFYGPKIDIK

SEQ ID NO: 537 - protein, 9 aa, Artificial Sequence
  candidate mimic peptide
GDGIARVHG

SEQ ID NO: 538 - protein, 10 aa, Artificial Sequence
  candidate mimic peptide
GDGIARVHGL

SEQ ID NO: 539 - protein, 9 aa, Artificial Sequence
  candidate mimic peptide
GDGIGPEIS

SEQ ID NO: 540 - protein, 10 aa, Artificial Sequence
  candidate mimic peptide
GDGVNDAPAL

SEQ ID NO: 541 - protein, 9 aa, Artificial Sequence
  candidate mimic peptide
GDIIIDGGN

SEQ ID NO: 542 - protein, 10 aa, Artificial Sequence
  candidate mimic peptide
GDMDFKIAGT

SEQ ID NO: 543 - protein, 9 aa, Artificial Sequence
  candidate mimic peptide
GDRVAIYMP

SEQ ID NO: 544 - protein, 9 aa, Artificial Sequence
  candidate mimic peptide
GDRVAVMLP

SEQ ID NO: 545 - protein, 12 aa, Artificial Sequence
  candidate mimic peptide
GDVLVLTKPLGT

SEQ ID NO: 546 - protein, 9 aa, Artificial Sequence
  candidate mimic peptide
GDWKGYTGK

SEQ ID NO: 547 - protein, 11 aa, Artificial Sequence
  candidate mimic peptide
GEEQVKIWRRS

SEQ ID NO: 548 - protein, 13 aa, Artificial Sequence
  candidate mimic peptide
GEERCIACKLCEA

SEQ ID NO: 549 - protein, 10 aa, Artificial Sequence
  candidate mimic peptide
GEIVSADSMQ

SEQ ID NO: 550 - protein, 9 aa, Artificial Sequence
  candidate mimic peptide
GENGAGKST

SEQ ID NO: 551 - protein, 9 aa, Artificial Sequence
  candidate mimic peptide
GEPVSAEDL

SEQ ID NO: 552 - protein, 12 aa, Artificial Sequence
  candidate mimic peptide
GERAYDIYSRLL

SEQ ID NO: 553 - protein, 9 aa, Artificial Sequence
  candidate mimic peptide
GEVMAIGRT

SEQ ID NO: 554 - protein, 13 aa, Artificial Sequence
  candidate mimic peptide
GEVMAIGRTFEES

SEQ ID NO: 555 - protein, 9 aa, Artificial Sequence
  candidate mimic peptide
GEVTEINEA

SEQ ID NO: 556 - protein, 13 aa, Artificial Sequence
  candidate mimic peptide
GFCHGVLNTDNMS

SEQ ID NO: 557 - protein, 9 aa, Artificial Sequence
  candidate mimic peptide
GFILDGFPR

SEQ ID NO: 558 - protein, 11 aa, Artificial Sequence
  candidate mimic peptide
GFLLDGFPRTV

SEQ ID NO: 559 - protein, 10 aa, Artificial Sequence
  candidate mimic peptide
GFPGETDQDF

SEQ ID NO: 560 - protein, 9 aa, Artificial Sequence
  candidate mimic peptide
GFPSVGKST

SEQ ID NO: 561 - protein, 12 aa, Artificial Sequence
  candidate mimic peptide
GFPSVGKSTLLS

SEQ ID NO: 562 - protein, 10 aa, Artificial Sequence
  candidate mimic peptide
GFRGEALASI

SEQ ID NO: 563 - protein, 11 aa, Artificial Sequence
  candidate mimic peptide
GFRGEALASIS

SEQ ID NO: 564 - protein, 9 aa, Artificial Sequence
  candidate mimic peptide
GFRGEALSS

SEQ ID NO: 565 - protein, 14 aa, Artificial Sequence
  candidate mimic peptide
GFVMGEGAAVLVLE

SEQ ID NO: 566 - protein, 9 aa, Artificial Sequence
  candidate mimic peptide
GFYSAFMVA

SEQ ID NO: 567 - protein, 10 aa, Artificial Sequence
  candidate mimic peptide
GGADRIELCS

SEQ ID NO: 568 - protein, 10 aa, Artificial Sequence
  candidate mimic peptide
GGAGVQHIAL

SEQ ID NO: 569 - protein, 9 aa, Artificial Sequence
  candidate mimic peptide
GGAGYIGSH

SEQ ID NO: 570 - protein, 10 aa, Artificial Sequence
  candidate mimic peptide
GGAGYIGSHT

SEQ ID NO: 571 - protein, 11 aa, Artificial Sequence
  candidate mimic peptide
GGAGYIGSHTV

SEQ ID NO: 572 - protein, 9 aa, Artificial Sequence
  candidate mimic peptide
GGAIALGHP

SEQ ID NO: 573 - protein, 11 aa, Artificial Sequence
  candidate mimic peptide
GGAIALGHPLG

SEQ ID NO: 574 - protein, 14 aa, Artificial Sequence
  candidate mimic peptide
GGAIALGHPLGASG

SEQ ID NO: 575 - protein, 10 aa, Artificial Sequence
  candidate mimic peptide
GGARGQATDI

SEQ ID NO: 576 - protein, 9 aa, Artificial Sequence
  candidate mimic peptide
GGDGTLLYA

SEQ ID NO: 577 - protein, 9 aa, Artificial Sequence
  candidate mimic peptide
GGENIYPAE

SEQ ID NO: 578 - protein, 10 aa, Artificial Sequence
  candidate mimic peptide
GGFGLCGIPE

SEQ ID NO: 579 - protein, 9 aa, Artificial Sequence
  candidate mimic peptide
GGGCSGFQY

SEQ ID NO: 580 - protein, 10 aa, Artificial Sequence
  candidate mimic peptide
GGGSIRIHNA

SEQ ID NO: 581 - protein, 11 aa, Artificial Sequence
  candidate mimic peptide
GGIDILVNNAS

SEQ ID NO: 582 - protein, 9 aa, Artificial Sequence
  candidate mimic peptide
GGILDDLIV

SEQ ID NO: 583 - protein, 9 aa, Artificial Sequence
  candidate mimic peptide
GGKPANFLD

SEQ ID NO: 584 - protein, 10 aa, Artificial Sequence
  candidate mimic peptide
GGLRTALYNY

SEQ ID NO: 585 - protein, 10 aa, Artificial Sequence
  candidate mimic peptide
GGLYPVSAVL

SEQ ID NO: 586 - protein, 9 aa, Artificial Sequence
  candidate mimic peptide
GGNGWLLDG

SEQ ID NO: 587 - protein, 9 aa, Artificial Sequence
  candidate mimic peptide
GGPPCQGFS

SEQ ID NO: 588 - protein, 10 aa, Artificial Sequence
  candidate mimic peptide
GGREHTLAWK

SEQ ID NO: 589 - protein, 9 aa, Artificial Sequence
  candidate mimic peptide
GGRYDGLVG

SEQ ID NO: 590 - protein, 9 aa, Artificial Sequence
  candidate mimic peptide
GGSAVDAAI

SEQ ID NO: 591 - protein, 10 aa, Artificial Sequence
  candidate mimic peptide
GGSDLGPLMV

SEQ ID NO: 592 - protein, 11 aa, Artificial Sequence
  candidate mimic peptide
GGSDLGPLMVT

SEQ ID NO: 593 - protein, 9 aa, Artificial Sequence
  candidate mimic peptide
GGSDNHLIL

SEQ ID NO: 594 - protein, 9 aa, Artificial Sequence
  candidate mimic peptide
GGSNGGLLV

SEQ ID NO: 595 - protein, 10 aa, Artificial Sequence
  candidate mimic peptide
GGSPTPFDRN

SEQ ID NO: 596 - protein, 9 aa, Artificial Sequence
  candidate mimic peptide
GGSRGIGRA

SEQ ID NO: 597 - protein, 11 aa, Artificial Sequence
  candidate mimic peptide
GGTCVNVGCVP

SEQ ID NO: 598 - protein, 16 aa, Artificial Sequence
  candidate mimic peptide
GGTCVNVGCVPKKVMW

SEQ ID NO: 599 - protein, 15 aa, Artificial Sequence
  candidate mimic peptide
GGTFTISNGGVFGSL

SEQ ID NO: 600 - protein, 9 aa, Artificial Sequence
  candidate mimic peptide
GGTVGDIES

SEQ ID NO: 601 - protein, 9 aa, Artificial Sequence
  candidate mimic peptide
GHGALAEKA

SEQ ID NO: 602 - protein, 10 aa, Artificial Sequence
  candidate mimic peptide
GHGALAEKAL

SEQ ID NO: 603 - protein, 9 aa, Artificial Sequence
  candidate mimic peptide
GHIAFNEPG

SEQ ID NO: 604 - protein, 9 aa, Artificial Sequence
  candidate mimic peptide
GHLRSTIIG

SEQ ID NO: 605 - protein, 9 aa, Artificial Sequence
  candidate mimic peptide
GHNGAGKST

SEQ ID NO: 606 - protein, 9 aa, Artificial Sequence
  candidate mimic peptide
GHNGAGKTT

SEQ ID NO: 607 - protein, 11 aa, Artificial Sequence
  candidate mimic peptide
GHPEVYILILP

SEQ ID NO: 608 - protein, 11 aa, Artificial Sequence
  candidate mimic peptide
GHPSFVMSNSF

SEQ ID NO: 609 - protein, 9 aa, Artificial Sequence
  candidate mimic peptide
GHSGAGKST

SEQ ID NO: 610 - protein, 11 aa, Artificial Sequence
  candidate mimic peptide
GHSGAGKSTLL

SEQ ID NO: 611 - protein, 10 aa, Artificial Sequence
  candidate mimic peptide
GHSMGGKTAM

SEQ ID NO: 612 - protein, 9 aa, Artificial Sequence
  candidate mimic peptide
GICGSDVHY

SEQ ID NO: 613 - protein, 9 aa, Artificial Sequence
  candidate mimic peptide
GICLGHQLL

SEQ ID NO: 614 - protein, 9 aa, Artificial Sequence
  candidate mimic peptide
GIDLGTTNS

SEQ ID NO: 615 - protein, 11 aa, Artificial Sequence
  candidate mimic peptide
GIDLGTTNSCV

SEQ ID NO: 616 - protein, 14 aa, Artificial Sequence
  candidate mimic peptide
GIDLGTTNSCVAVM

SEQ ID NO: 617 - protein, 9 aa, Artificial Sequence
  candidate mimic peptide
GIGGSDLGP

SEQ ID NO: 618 - protein, 9 aa, Artificial Sequence
  candidate mimic peptide
GIGPVPAIS

SEQ ID NO: 619 - protein, 11 aa, Artificial Sequence
  candidate mimic peptide
GIIDLKELEAA

SEQ ID NO: 620 - protein, 13 aa, Artificial Sequence
  candidate mimic peptide
GIIVSNHGGRQLD

SEQ ID NO: 621 - protein, 9 aa, Artificial Sequence
  candidate mimic peptide
GILLYGPPG

SEQ ID NO: 622 - protein, 9 aa, Artificial Sequence
  candidate mimic peptide
GILVQLPLP

SEQ ID NO: 623 - protein, 11 aa, Artificial Sequence
  candidate mimic peptide
GILVQLPLPDH

SEQ ID NO: 624 - protein, 18 aa, Artificial Sequence
  candidate mimic peptide
GIMAHIDAGKTTTTERIL

SEQ ID NO: 625 - protein, 20 aa, Artificial Sequence
  candidate mimic peptide
GIMAHIDAGKTTTTERILYY

SEQ ID NO: 626 - protein, 10 aa, Artificial Sequence
  candidate mimic peptide
GINGFGRIGR

SEQ ID NO: 627 - protein, 11 aa, Artificial Sequence
  candidate mimic peptide
GINGFGRIGRL

SEQ ID NO: 628 - protein, 9 aa, Artificial Sequence
  candidate mimic peptide
GINGTVGGS

SEQ ID NO: 629 - protein, 9 aa, Artificial Sequence
  candidate mimic peptide
GIPFYVAAP

SEQ ID NO: 630 - protein, 9 aa, Artificial Sequence
  candidate mimic peptide
GIPIAVKDN

SEQ ID NO: 631 - protein, 12 aa, Artificial Sequence
  candidate mimic peptide
GISGAIQHLAGM

SEQ ID NO: 632 - protein, 12 aa, Artificial Sequence
  candidate mimic peptide
GIVGLPNVGKST

SEQ ID NO: 633 - protein, 9 aa, Artificial Sequence
  candidate mimic peptide
GIVHRDIKP

SEQ ID NO: 634 - protein, 10 aa, Artificial Sequence
  candidate mimic peptide
GKAGRNRWLG

SEQ ID NO: 635 - protein, 13 aa, Artificial Sequence
  candidate mimic peptide
GKAGRNRWLGKRP

SEQ ID NO: 636 - protein, 11 aa, Artificial Sequence
  candidate mimic peptide
GKGFQGVMKRW

SEQ ID NO: 637 - protein, 12 aa, Artificial Sequence
  candidate mimic peptide
GKGRPGWHIECS

SEQ ID NO: 638 - protein, 10 aa, Artificial Sequence
  candidate mimic peptide
GKKVAIIGAG

SEQ ID NO: 639 - protein, 13 aa, Artificial Sequence
  candidate mimic peptide
GKLHTGRSRNDQV

SEQ ID NO: 640 - protein, 19 aa, Artificial Sequence
  candidate mimic peptide
GKLNDHFPLVVWQTGSGTQ

SEQ ID NO: 641 - protein, 9 aa, Artificial Sequence
  candidate mimic peptide
GKLTARERI

SEQ ID NO: 642 - protein, 9 aa, Artificial Sequence
  candidate mimic peptide
GKPDPDIFL

SEQ ID NO: 643 - protein, 9 aa, Artificial Sequence
  candidate mimic peptide
GKRVDFSGR

SEQ ID NO: 644 - protein, 9 aa, Artificial Sequence
  candidate mimic peptide
GKSTLINTL

SEQ ID NO: 645 - protein, 9 aa, Artificial Sequence
  candidate mimic peptide
GKSTLLNIL

SEQ ID NO: 646 - protein, 9 aa, Artificial Sequence
  candidate mimic peptide
GKSTLMNIL

SEQ ID NO: 647 - protein, 9 aa, Artificial Sequence
  candidate mimic peptide
GKSTLVNTL

SEQ ID NO: 648 - protein, 9 aa, Artificial Sequence
  candidate mimic peptide
GKTALMMAA

SEQ ID NO: 649 - protein, 9 aa, Artificial Sequence
  candidate mimic peptide
GKTLAYLLP

SEQ ID NO: 650 - protein, 10 aa, Artificial Sequence
  candidate mimic peptide
GKTLLAQTLA

SEQ ID NO: 651 - protein, 9 aa, Artificial Sequence
  candidate mimic peptide
GKTNLDEFA

SEQ ID NO: 652 - protein, 11 aa, Artificial Sequence
  candidate mimic peptide
GKTNLDEFAMG

SEQ ID NO: 653 - protein, 12 aa, Artificial Sequence
  candidate mimic peptide
GKTNLDEFAMGS

SEQ ID NO: 654 - protein, 10 aa, Artificial Sequence
  candidate mimic peptide
GKTSIARSIA

SEQ ID NO: 655 - protein, 11 aa, Artificial Sequence
  candidate mimic peptide
GKVADYIPQLA

SEQ ID NO: 656 - protein, 11 aa, Artificial Sequence
  candidate mimic peptide
GKWMDGWETRR

SEQ ID NO: 657 - protein, 13 aa, Artificial Sequence
  candidate mimic peptide
GKWMDGWETRRKR

SEQ ID NO: 658 - protein, 9 aa, Artificial Sequence
  candidate mimic peptide
GLAAGKGVI

SEQ ID NO: 659 - protein, 13 aa, Artificial Sequence
  candidate mimic peptide
GLAARDSLRLEAG

SEQ ID NO: 660 - protein, 10 aa, Artificial Sequence
  candidate mimic peptide
GLFDLKAAGF

SEQ ID NO: 661 - protein, 13 aa, Artificial Sequence
  candidate mimic peptide
GLFDLKAAGFKDP

SEQ ID NO: 662 - protein, 9 aa, Artificial Sequence
  candidate mimic peptide
GLIIGKGGA

SEQ ID NO: 663 - protein, 10 aa, Artificial Sequence
  candidate mimic peptide
GLLGPNGAGK

SEQ ID NO: 664 - protein, 12 aa, Artificial Sequence
  candidate mimic peptide
GLLGPNGAGKST

SEQ ID NO: 665 - protein, 13 aa, Artificial Sequence
  candidate mimic peptide
GLLGPNGAGKSTI

SEQ ID NO: 666 - protein, 9 aa, Artificial Sequence
  candidate mimic peptide
GLNKNLGFS

SEQ ID NO: 667 - protein, 13 aa, Artificial Sequence
  candidate mimic peptide
GLNKNLGFSPEDR

SEQ ID NO: 668 - protein, 9 aa, Artificial Sequence
  candidate mimic peptide
GLPNVGKST

SEQ ID NO: 669 - protein, 10 aa, Artificial Sequence
  candidate mimic peptide
GLPSHPQHEL

SEQ ID NO: 670 - protein, 10 aa, Artificial Sequence
  candidate mimic peptide
GLQGSGKTTT

SEQ ID NO: 671 - protein, 9 aa, Artificial Sequence
  candidate mimic peptide
GLQVGDVIL

SEQ ID NO: 672 - protein, 9 aa, Artificial Sequence
  candidate mimic peptide
GLSKLARIV

SEQ ID NO: 673 - protein, 9 aa, Artificial Sequence
  candidate mimic peptide
GLTAYFGLL

SEQ ID NO: 674 - protein, 10 aa, Artificial Sequence
  candidate mimic peptide
GLTERFELFV

SEQ ID NO: 675 - protein, 11 aa, Artificial Sequence
  candidate mimic peptide
GLTGGIASGKS

SEQ ID NO: 676 - protein, 13 aa, Artificial Sequence
  candidate mimic peptide
GLTGGIASGKSSV

SEQ ID NO: 677 - protein, 10 aa, Artificial Sequence
  candidate mimic peptide
GLVNNAGIST

SEQ ID NO: 678 - protein, 9 aa, Artificial Sequence
  candidate mimic peptide
GMGGAMDLV

SEQ ID NO: 679 - protein, 9 aa, Artificial Sequence
  candidate mimic peptide
GMGIPSISI

SEQ ID NO: 680 - protein, 9 aa, Artificial Sequence
  candidate mimic peptide
GMNAAVRAV

SEQ ID NO: 681 - protein, 10 aa, Artificial Sequence
  candidate mimic peptide
GMNAAVRAVV

SEQ ID NO: 682 - protein, 11 aa, Artificial Sequence
  candidate mimic peptide
GMNAAVRAVVR

SEQ ID NO: 683 - protein, 11 aa, Artificial Sequence
  candidate mimic peptide
GMVITIEPGIY

SEQ ID NO: 684 - protein, 9 aa, Artificial Sequence
  candidate mimic peptide
GMYSALAGF

SEQ ID NO: 685 - protein, 9 aa, Artificial Sequence
  candidate mimic peptide
GNLCRCTGY

SEQ ID NO: 686 - protein, 9 aa, Artificial Sequence
  candidate mimic peptide
GNLNAPTIM

SEQ ID NO: 687 - protein, 13 aa, Artificial Sequence
  candidate mimic peptide
GNLNAPTIMIAEK

SEQ ID NO: 688 - protein, 9 aa, Artificial Sequence
  candidate mimic peptide
GNNGGDGLV

SEQ ID NO: 689 - protein, 10 aa, Artificial Sequence
  candidate mimic peptide
GNPRPRVFRL

SEQ ID NO: 690 - protein, 11 aa, Artificial Sequence
  candidate mimic peptide
GNPRPRVFRLP

SEQ ID NO: 691 - protein, 9 aa, Artificial Sequence
  candidate mimic peptide
GNTGIGLAL

SEQ ID NO: 692 - protein, 9 aa, Artificial Sequence
  candidate mimic peptide
GNTVVIKPA

SEQ ID NO: 693 - protein, 11 aa, Artificial Sequence
  candidate mimic peptide
GNWDLVGNNTP

SEQ ID NO: 694 - protein, 9 aa, Artificial Sequence
  candidate mimic peptide
GPCGPCSEI

SEQ ID NO: 695 - protein, 10 aa, Artificial Sequence
  candidate mimic peptide
GPCGPCTEIH

SEQ ID NO: 696 - protein, 9 aa, Artificial Sequence
  candidate mimic peptide
GPFANIAHG

SEQ ID NO: 697 - protein, 10 aa, Artificial Sequence
  candidate mimic peptide
GPFANIAHGN

SEQ ID NO: 698 - protein, 9 aa, Artificial Sequence
  candidate mimic peptide
GPGGYVAAI

SEQ ID NO: 699 - protein, 15 aa, Artificial Sequence
  candidate mimic peptide
GPGGYVAAIKAAQLG

SEQ ID NO: 700 - protein, 9 aa, Artificial Sequence
  candidate mimic peptide
GPGTGIAPF

SEQ ID NO: 701 - protein, 10 aa, Artificial Sequence
  candidate mimic peptide
GPNGAGKSTI

SEQ ID NO: 702 - protein, 9 aa, Artificial Sequence
  candidate mimic peptide
GPNGAGKTT

SEQ ID NO: 703 - protein, 9 aa, Artificial Sequence
  candidate mimic peptide
GPNGSGKSN

SEQ ID NO: 704 - protein, 9 aa, Artificial Sequence
  candidate mimic peptide
GPNGSGKST

SEQ ID NO: 705 - protein, 9 aa, Artificial Sequence
  candidate mimic peptide
GPNTGGMGA

SEQ ID NO: 706 - protein, 10 aa, Artificial Sequence
  candidate mimic peptide
GPNTGGMGAY

SEQ ID NO: 707 - protein, 11 aa, Artificial Sequence
  candidate mimic peptide
GPNTNGSQFFI

SEQ ID NO: 708 - protein, 11 aa, Artificial Sequence
  candidate mimic peptide
GPPGAGKGTQA

SEQ ID NO: 709 - protein, 9 aa, Artificial Sequence
  candidate mimic peptide
GPPGCGKTL

SEQ ID NO: 710 - protein, 9 aa, Artificial Sequence
  candidate mimic peptide
GPPGLGKTT

SEQ ID NO: 711 - protein, 10 aa, Artificial Sequence
  candidate mimic peptide
GPPGLGKTTL

SEQ ID NO: 712 - protein, 11 aa, Artificial Sequence
  candidate mimic peptide
GPPGLGKTTLA

SEQ ID NO: 713 - protein, 12 aa, Artificial Sequence
  candidate mimic peptide
GPPGLGKTTLAH

SEQ ID NO: 714 - protein, 9 aa, Artificial Sequence
  candidate mimic peptide
GPPGSGKGT

SEQ ID NO: 715 - protein, 9 aa, Artificial Sequence
  candidate mimic peptide
GPPGTGKTL

SEQ ID NO: 716 - protein, 11 aa, Artificial Sequence
  candidate mimic peptide
GPPGTGKTLLA

SEQ ID NO: 717 - protein, 13 aa, Artificial Sequence
  candidate mimic peptide
GPPGTGKTLLAKA

SEQ ID NO: 718 - protein, 9 aa, Artificial Sequence
  candidate mimic peptide
GPPGTGKTT

SEQ ID NO: 719 - protein, 9 aa, Artificial Sequence
  candidate mimic peptide
GPPGVGKTS

SEQ ID NO: 720 - protein, 11 aa, Artificial Sequence
  candidate mimic peptide
GPPGVGKTSIA

SEQ ID NO: 721 - protein, 9 aa, Artificial Sequence
  candidate mimic peptide
GPPHDRRFT

SEQ ID NO: 722 - protein, 14 aa, Artificial Sequence
  candidate mimic peptide
GPQHPAAHGVLRLV

SEQ ID NO: 723 - protein, 9 aa, Artificial Sequence
  candidate mimic peptide
GPRYCPSIE

SEQ ID NO: 724 - protein, 9 aa, Artificial Sequence
  candidate mimic peptide
GPSGAGKST

SEQ ID NO: 725 - protein, 10 aa, Artificial Sequence
  candidate mimic peptide
GPSGAGKSTF

SEQ ID NO: 726 - protein, 10 aa, Artificial Sequence
  candidate mimic peptide
GPSGAGKSTL

SEQ ID NO: 727 - protein, 11 aa, Artificial Sequence
  candidate mimic peptide
GPSGAGKSTLL

SEQ ID NO: 728 - protein, 9 aa, Artificial Sequence
  candidate mimic peptide
GPSGSGKSS

SEQ ID NO: 729 - protein, 9 aa, Artificial Sequence
  candidate mimic peptide
GPSGSGKST

SEQ ID NO: 730 - protein, 11 aa, Artificial Sequence
  candidate mimic peptide
GPTGSGKTLLA

SEQ ID NO: 731 - protein, 12 aa, Artificial Sequence
  candidate mimic peptide
GPTGSGKTLLAQ

SEQ ID NO: 732 - protein, 13 aa, Artificial Sequence
  candidate mimic peptide
GPTGSGKTLLAQT

SEQ ID NO: 733 - protein, 15 aa, Artificial Sequence
  candidate mimic peptide
GPTGSGKTLLAQTLA

SEQ ID NO: 734 - protein, 16 aa, Artificial Sequence
  candidate mimic peptide
GPTGSGKTLLAQTLAK

SEQ ID NO: 735 - protein, 11 aa, Artificial Sequence
  candidate mimic peptide
GQDPYHGPNQA

SEQ ID NO: 736 - protein, 14 aa, Artificial Sequence
  candidate mimic peptide
GQDVLLFIDNIFRF

SEQ ID NO: 737 - protein, 9 aa, Artificial Sequence
  candidate mimic peptide
GQEVTLCGW

SEQ ID NO: 738 - protein, 9 aa, Artificial Sequence
  candidate mimic peptide
GQKCSACSR

SEQ ID NO: 739 - protein, 10 aa, Artificial Sequence
  candidate mimic peptide
GQMNEPPGAR

SEQ ID NO: 740 - protein, 11 aa, Artificial Sequence
  candidate mimic peptide
GQRELIIGDRQ

SEQ ID NO: 741 - protein, 15 aa, Artificial Sequence
  candidate mimic peptide
GQRELIIGDRQTGKT

SEQ ID NO: 742 - protein, 9 aa, Artificial Sequence
  candidate mimic peptide
GRELGLPEE

SEQ ID NO: 743 - protein, 13 aa, Artificial Sequence
  candidate mimic peptide
GRFVIGGPQGDAG

SEQ ID NO: 744 - protein, 14 aa, Artificial Sequence
  candidate mimic peptide
GRGERAYDIYSRLL

SEQ ID NO: 745 - protein, 10 aa, Artificial Sequence
  candidate mimic peptide
GRGGAGFPTG

SEQ ID NO: 746 - protein, 16 aa, Artificial Sequence
  candidate mimic peptide
GRGQRELIIGDRQTGK

SEQ ID NO: 747 - protein, 17 aa, Artificial Sequence
  candidate mimic peptide
GRGQRELIIGDRQTGKT

SEQ ID NO: 748 - protein, 9 aa, Artificial Sequence
  candidate mimic peptide
GRGTSTYDG

SEQ ID NO: 749 - protein, 9 aa, Artificial Sequence
  candidate mimic peptide
GRIDILVNN

SEQ ID NO: 750 - protein, 9 aa, Artificial Sequence
  candidate mimic peptide
GRIVETEAY

SEQ ID NO: 751 - protein, 10 aa, Artificial Sequence
  candidate mimic peptide
GRKMSKSLGN

SEQ ID NO: 752 - protein, 11 aa, Artificial Sequence
  candidate mimic peptide
GRKMSKSLGNV

SEQ ID NO: 753 - protein, 9 aa, Artificial Sequence
  candidate mimic peptide
GRLDVLVNN

SEQ ID NO: 754 - protein, 11 aa, Artificial Sequence
  candidate mimic peptide
GRLKTGTPPRI

SEQ ID NO: 755 - protein, 10 aa, Artificial Sequence
  candidate mimic peptide
GRNIIHGSDS

SEQ ID NO: 756 - protein, 10 aa, Artificial Sequence
  candidate mimic peptide
GRPGWHIECS

SEQ ID NO: 757 - protein, 11 aa, Artificial Sequence
  candidate mimic peptide
GRPGWHIECSA

SEQ ID NO: 758 - protein, 12 aa, Artificial Sequence
  candidate mimic peptide
GRPGWHIECSAM

SEQ ID NO: 759 - protein, 13 aa, Artificial Sequence
  candidate mimic peptide
GRPGWHIECSAMA

SEQ ID NO: 760 - protein, 9 aa, Artificial Sequence
  candidate mimic peptide
GRSNVGKSS

SEQ ID NO: 761 - protein, 10 aa, Artificial Sequence
  candidate mimic peptide
GRSNVGKSSL

SEQ ID NO: 762 - protein, 11 aa, Artificial Sequence
  candidate mimic peptide
GRSNVGKSSLI

SEQ ID NO: 763 - protein, 9 aa, Artificial Sequence
  candidate mimic peptide
GRVKTLHPA

SEQ ID NO: 764 - protein, 11 aa, Artificial Sequence
  candidate mimic peptide
GRVKTLHPAVH

SEQ ID NO: 765 - protein, 9 aa, Artificial Sequence
  candidate mimic peptide
GRVQGVCFR

SEQ ID NO: 766 - protein, 10 aa, Artificial Sequence
  candidate mimic peptide
GRYREFYQCD

SEQ ID NO: 767 - protein, 10 aa, Artificial Sequence
  candidate mimic peptide
GSDFIKTSTG

SEQ ID NO: 768 - protein, 11 aa, Artificial Sequence
  candidate mimic peptide
GSIRSPLWRGG

SEQ ID NO: 769 - protein, 10 aa, Artificial Sequence
  candidate mimic peptide
GSLTTPPCSE

SEQ ID NO: 770 - protein, 10 aa, Artificial Sequence
  candidate mimic peptide
GSLTTPPCTE

SEQ ID NO: 771 - protein, 9 aa, Artificial Sequence
  candidate mimic peptide
GSPAEKAGL

SEQ ID NO: 772 - protein, 9 aa, Artificial Sequence
  candidate mimic peptide
GSSQRFGVP

SEQ ID NO: 773 - protein, 9 aa, Artificial Sequence
  candidate mimic peptide
GSVPHGGFG

SEQ ID NO: 774 - protein, 9 aa, Artificial Sequence
  candidate mimic peptide
GTDVAKEAS

SEQ ID NO: 775 - protein, 9 aa, Artificial Sequence
  candidate mimic peptide
GTGKTLLAR

SEQ ID NO: 776 - protein, 9 aa, Artificial Sequence
  candidate mimic peptide
GTIGHVDHG

SEQ ID NO: 777 - protein, 10 aa, Artificial Sequence
  candidate mimic peptide
GTKFDSSLDR

SEQ ID NO: 778 - protein, 9 aa, Artificial Sequence
  candidate mimic peptide
GTPDYLAPE

SEQ ID NO: 779 - protein, 10 aa, Artificial Sequence
  candidate mimic peptide
GTPVLDIKPY

SEQ ID NO: 780 - protein, 9 aa, Artificial Sequence
  candidate mimic peptide
GTQYRSAIY

SEQ ID NO: 781 - protein, 10 aa, Artificial Sequence
  candidate mimic peptide
GTQYRSAIYP

SEQ ID NO: 782 - protein, 11 aa, Artificial Sequence
  candidate mimic peptide
GTSSLRRAAQL

SEQ ID NO: 783 - protein, 9 aa, Artificial Sequence
  candidate mimic peptide
GTSSRSTKL

SEQ ID NO: 784 - protein, 9 aa, Artificial Sequence
  candidate mimic peptide
GTVGAVALD

SEQ ID NO: 785 - protein, 9 aa, Artificial Sequence
  candidate mimic peptide
GTVTAANSS

SEQ ID NO: 786 - protein, 10 aa, Artificial Sequence
  candidate mimic peptide
GVAHAGWKGT

SEQ ID NO: 787 - protein, 9 aa, Artificial Sequence
  candidate mimic peptide
GVDEAGRGP

SEQ ID NO: 788 - protein, 14 aa, Artificial Sequence
  candidate mimic peptide
GVENLRVVDASIMP

SEQ ID NO: 789 - protein, 11 aa, Artificial Sequence
  candidate mimic peptide
GVGERTREGND

SEQ ID NO: 790 - protein, 13 aa, Artificial Sequence
  candidate mimic peptide
GVGERTREGNDLY

SEQ ID NO: 791 - protein, 9 aa, Artificial Sequence
  candidate mimic peptide
GVHRVQRVP

SEQ ID NO: 792 - protein, 12 aa, Artificial Sequence
  candidate mimic peptide
GVHRVQRVPKTE

SEQ ID NO: 793 - protein, 9 aa, Artificial Sequence
  candidate mimic peptide
GVIINTASV

SEQ ID NO: 794 - protein, 9 aa, Artificial Sequence
  candidate mimic peptide
GVKKGDRVV

SEQ ID NO: 795 - protein, 9 aa, Artificial Sequence
  candidate mimic peptide
GVLGEHGRG

SEQ ID NO: 796 - protein, 9 aa, Artificial Sequence
  candidate mimic peptide
GVLVPGGFG

SEQ ID NO: 797 - protein, 9 aa, Artificial Sequence
  candidate mimic peptide
GVMLRGSGI

SEQ ID NO: 798 - protein, 11 aa, Artificial Sequence
  candidate mimic peptide
GVPFNIASYAL

SEQ ID NO: 799 - protein, 10 aa, Artificial Sequence
  candidate mimic peptide
GVPIIADGGI

SEQ ID NO: 800 - protein, 10 aa, Artificial Sequence
  candidate mimic peptide
GWDAFGLPAE

SEQ ID NO: 801 - protein, 10 aa, Artificial Sequence
  candidate mimic peptide
GWDCHGLPVE

SEQ ID NO: 802 - protein, 9 aa, Artificial Sequence
  candidate mimic peptide
GWKEIEYEV

SEQ ID NO: 803 - protein, 9 aa, Artificial Sequence
  candidate mimic peptide
GWKKNGWKT

SEQ ID NO: 804 - protein, 10 aa, Artificial Sequence
  candidate mimic peptide
GWKKNGWKTS

SEQ ID NO: 805 - protein, 9 aa, Artificial Sequence
  candidate mimic peptide
GWLHTGDIG

SEQ ID NO: 806 - protein, 9 aa, Artificial Sequence
  candidate mimic peptide
GWYMGTEIG

SEQ ID NO: 807 - protein, 9 aa, Artificial Sequence
  candidate mimic peptide
GYEEAAAQG

SEQ ID NO: 808 - protein, 11 aa, Artificial Sequence
  candidate mimic peptide
GYGGPHAAFFA

SEQ ID NO: 809 - protein, 9 aa, Artificial Sequence
  candidate mimic peptide
GYGIRYEYG

SEQ ID NO: 810 - protein, 12 aa, Artificial Sequence
  candidate mimic peptide
GYLGAGKTTLLN

SEQ ID NO: 811 - protein, 9 aa, Artificial Sequence
  candidate mimic peptide
GYLHIGHAK

SEQ ID NO: 812 - protein, 9 aa, Artificial Sequence
  candidate mimic peptide
GYLSDRFGR

SEQ ID NO: 813 - protein, 17 aa, Artificial Sequence
  candidate mimic peptide
GYSVFAGVGERTREGND

SEQ ID NO: 814 - protein, 19 aa, Artificial Sequence
  candidate mimic peptide
GYSVFAGVGERTREGNDLY

SEQ ID NO: 815 - protein, 22 aa, Artificial Sequence
  candidate mimic peptide
GYSVFAGVGERTREGNDLYHEM

SEQ ID NO: 816 - protein, 9 aa, Artificial Sequence
  candidate mimic peptide
GYTGEDGVE

SEQ ID NO: 817 - protein, 9 aa, Artificial Sequence
  candidate mimic peptide
GYTKDYPVE

SEQ ID NO: 818 - protein, 9 aa, Artificial Sequence
  candidate mimic peptide
GYTKDYPVE

SEQ ID NO: 819 - protein, 9 aa, Artificial Sequence
  candidate mimic peptide
HDGPPYANG

SEQ ID NO: 820 - protein, 10 aa, Artificial Sequence
  candidate mimic peptide
HDLGHGPFSH

SEQ ID NO: 821 - protein, 9 aa, Artificial Sequence
  candidate mimic peptide
HEIGHTLGL

SEQ ID NO: 822 - protein, 9 aa, Artificial Sequence
  candidate mimic peptide
HEWEKHGTC

SEQ ID NO: 823 - protein, 14 aa, Artificial Sequence
  candidate mimic peptide
HFDRERIPERVVHA

SEQ ID NO: 824 - protein, 14 aa, Artificial Sequence
  candidate mimic peptide
HFPLVVWQTGSGTQ

SEQ ID NO: 825 - protein, 23 aa, Artificial Sequence
  candidate mimic peptide
HFPLVVWQTGSGTQTNMNVNEVI

SEQ ID NO: 826 - protein, 9 aa, Artificial Sequence
  candidate mimic peptide
HFTSPIRRY

SEQ ID NO: 827 - protein, 9 aa, Artificial Sequence
  candidate mimic peptide
HGALYHSQS

SEQ ID NO: 828 - protein, 10 aa, Artificial Sequence
  candidate mimic peptide
HGATGKGNDQ

SEQ ID NO: 829 - protein, 9 aa, Artificial Sequence
  candidate mimic peptide
HGDGYPFDG

SEQ ID NO: 830 - protein, 10 aa, Artificial Sequence
  candidate mimic peptide
HGIPFYVAAP

SEQ ID NO: 831 - protein, 9 aa, Artificial Sequence
  candidate mimic peptide
HGSDSVESA

SEQ ID NO: 832 - protein, 10 aa, Artificial Sequence
  candidate mimic peptide
HGSTYGGNPL

SEQ ID NO: 833 - protein, 9 aa, Artificial Sequence
  candidate mimic peptide
HGTAPDIAG

SEQ ID NO: 834 - protein, 9 aa, Artificial Sequence
  candidate mimic peptide
HHPEWFNVY

SEQ ID NO: 835 - protein, 12 aa, Artificial Sequence
  candidate mimic peptide
HHPEWFNVYNKV

SEQ ID NO: 836 - protein, 9 aa, Artificial Sequence
  candidate mimic peptide
HHTFFEMLG

SEQ ID NO: 837 - protein, 9 aa, Artificial Sequence
  candidate mimic peptide
HIDMDAFYA

SEQ ID NO: 838 - protein, 9 aa, Artificial Sequence
  candidate mimic peptide
HKMAEANRA

SEQ ID NO: 839 - protein, 10 aa, Artificial Sequence
  candidate mimic peptide
HLGHVFPDGP

SEQ ID NO: 840 - protein, 12 aa, Artificial Sequence
  candidate mimic peptide
HLGHVFPDGPGP

SEQ ID NO: 841 - protein, 14 aa, Artificial Sequence
  candidate mimic peptide
HLGHVFPDGPGPNG

SEQ ID NO: 842 - protein, 11 aa, Artificial Sequence
  candidate mimic peptide
HLLGTHDFSAF

SEQ ID NO: 843 - protein, 10 aa, Artificial Sequence
  candidate mimic peptide
HMGITAENVA

SEQ ID NO: 844 - protein, 10 aa, Artificial Sequence
  candidate mimic peptide
HNERLEFLGD

SEQ ID NO: 845 - protein, 11 aa, Artificial Sequence
  candidate mimic peptide
HNERLEFLGDA

SEQ ID NO: 846 - protein, 12 aa, Artificial Sequence
  candidate mimic peptide
HNERLEFLGDAV

SEQ ID NO: 847 - protein, 9 aa, Artificial Sequence
  candidate mimic peptide
HNPTGIDPT

SEQ ID NO: 848 - protein, 12 aa, Artificial Sequence
  candidate mimic peptide
HPDIKAISFVGS

SEQ ID NO: 849 - protein, 13 aa, Artificial Sequence
  candidate mimic peptide
HPDLRRILTDYGF

SEQ ID NO: 850 - protein, 15 aa, Artificial Sequence
  candidate mimic peptide
HPDLRRILTDYGFEG

SEQ ID NO: 851 - protein, 17 aa, Artificial Sequence
  candidate mimic peptide
HPDLRRILTDYGFEGHP

SEQ ID NO: 852 - protein, 9 aa, Artificial Sequence
  candidate mimic peptide
HPDRNPDDP

SEQ ID NO: 853 - protein, 9 aa, Artificial Sequence
  candidate mimic peptide
HPESYHSFM

SEQ ID NO: 854 - protein, 9 aa, Artificial Sequence
  candidate mimic peptide
HPFPGPGLA

SEQ ID NO: 855 - protein, 9 aa, Artificial Sequence
  candidate mimic peptide
HPHRGFETV

SEQ ID NO: 856 - protein, 9 aa, Artificial Sequence
  candidate mimic peptide
HPLAGQGVN

SEQ ID NO: 857 - protein, 11 aa, Artificial Sequence
  candidate mimic peptide
HQTGHNSGVIH

SEQ ID NO: 858 - protein, 10 aa, Artificial Sequence
  candidate mimic peptide
HRDIKPENIL

SEQ ID NO: 859 - protein, 10 aa, Artificial Sequence
  candidate mimic peptide
HRDIKPGNIM

SEQ ID NO: 860 - protein, 10 aa, Artificial Sequence
  candidate mimic peptide
HRFAAYFQQG

SEQ ID NO: 861 - protein, 9 aa, Artificial Sequence
  candidate mimic peptide
HRGRLNVLA

SEQ ID NO: 862 - protein, 10 aa, Artificial Sequence
  candidate mimic peptide
HRSHIDYLLL

SEQ ID NO: 863 - protein, 10 aa, Artificial Sequence
  candidate mimic peptide
HRVQRVPKTE

SEQ ID NO: 864 - protein, 10 aa, Artificial Sequence
  candidate mimic peptide
HTGDSVVVAP

SEQ ID NO: 865 - protein, 10 aa, Artificial Sequence
  candidate mimic peptide
HTGRSRNDQV

SEQ ID NO: 866 - protein, 11 aa, Artificial Sequence
  candidate mimic peptide
HTNFSTKAMRE

SEQ ID NO: 867 - protein, 9 aa, Artificial Sequence
  candidate mimic peptide
HTNGSQFFI

SEQ ID NO: 868 - protein, 12 aa, Artificial Sequence
  candidate mimic peptide
HTVCEEARCPNI

SEQ ID NO: 869 - protein, 9 aa, Artificial Sequence
  candidate mimic peptide
HVRGGGELG

SEQ ID NO: 870 - protein, 11 aa, Artificial Sequence
  candidate mimic peptide
HVSTGGGASLE

SEQ ID NO: 871 - protein, 11 aa, Artificial Sequence
  candidate mimic peptide
IAAGEVIQRPA

SEQ ID NO: 872 - protein, 11 aa, Artificial Sequence
  candidate mimic peptide
IAATNRPDVLD

SEQ ID NO: 873 - protein, 10 aa, Artificial Sequence
  candidate mimic peptide
IACGTSYHAG

SEQ ID NO: 874 - protein, 11 aa, Artificial Sequence
  candidate mimic peptide
IADVGLVGFPN

SEQ ID NO: 875 - protein, 9 aa, Artificial Sequence
  candidate mimic peptide
IAHRLSTIQ

SEQ ID NO: 876 - protein, 11 aa, Artificial Sequence
  candidate mimic peptide
IAHVDHGKSTL

SEQ ID NO: 877 - protein, 9 aa, Artificial Sequence
  candidate mimic peptide
IAREMNLSE

SEQ ID NO: 878 - protein, 10 aa, Artificial Sequence
  candidate mimic peptide
IAREMNLSET

SEQ ID NO: 879 - protein, 9 aa, Artificial Sequence
  candidate mimic peptide
IATGHYART

SEQ ID NO: 880 - protein, 10 aa, Artificial Sequence
  candidate mimic peptide
IAVGSDADIV

SEQ ID NO: 881 - protein, 10 aa, Artificial Sequence
  candidate mimic peptide
IAVLTSGGDA

SEQ ID NO: 882 - protein, 9 aa, Artificial Sequence
  candidate mimic peptide
ICPVGALTS

SEQ ID NO: 883 - protein, 10 aa, Artificial Sequence
  candidate mimic peptide
IDGLIVTNTT

SEQ ID NO: 884 - protein, 12 aa, Artificial Sequence
  candidate mimic peptide
IDLAIDGADEVD

SEQ ID NO: 885 - protein, 9 aa, Artificial Sequence
  candidate mimic peptide
IDLIIPRGS

SEQ ID NO: 886 - protein, 10 aa, Artificial Sequence
  candidate mimic peptide
IDQLKPGGRL

SEQ ID NO: 887 - protein, 11 aa, Artificial Sequence
  candidate mimic peptide
IDTCQGDSGGP

SEQ ID NO: 888 - protein, 9 aa, Artificial Sequence
  candidate mimic peptide
IDTGMGLER

SEQ ID NO: 889 - protein, 11 aa, Artificial Sequence
  candidate mimic peptide
IDTGMGLERLV

SEQ ID NO: 890 - protein, 11 aa, Artificial Sequence
  candidate mimic peptide
IDTGMGLERLV

SEQ ID NO: 891 - protein, 15 aa, Artificial Sequence
  candidate mimic peptide
IDTPGHVDFTIEVER

SEQ ID NO: 892 - protein, 10 aa, Artificial Sequence
  candidate mimic peptide
IDVWEHAYYL

SEQ ID NO: 893 - protein, 9 aa, Artificial Sequence
  candidate mimic peptide
IEAHGTGTK

SEQ ID NO: 894 - protein, 10 aa, Artificial Sequence
  candidate mimic peptide
IFITHLHGDH

SEQ ID NO: 895 - protein, 13 aa, Artificial Sequence
  candidate mimic peptide
IFLRELISNASDA

SEQ ID NO: 896 - protein, 9 aa, Artificial Sequence
  candidate mimic peptide
IGGADMPVV

SEQ ID NO: 897 - protein, 10 aa, Artificial Sequence
  candidate mimic peptide
IGGDGSLTGA

SEQ ID NO: 898 - protein, 11 aa, Artificial Sequence
  candidate mimic peptide
IGGGMAYTFLK

SEQ ID NO: 899 - protein, 9 aa, Artificial Sequence
  candidate mimic peptide
IGIAMGSGT

SEQ ID NO: 900 - protein, 10 aa, Artificial Sequence
  candidate mimic peptide
IGIGGSDLGP

SEQ ID NO: 901 - protein, 9 aa, Artificial Sequence
  candidate mimic peptide
IGKAGRNRW

SEQ ID NO: 902 - protein, 14 aa, Artificial Sequence
  candidate mimic peptide
IGKAGRNRWLGKRP

SEQ ID NO: 903 - protein, 16 aa, Artificial Sequence
  candidate mimic peptide
IGKGFQGVMKRWGFKG

SEQ ID NO: 904 - protein, 16 aa, Artificial Sequence
  candidate mimic peptide
IGLAVMGQNLILNMND

SEQ ID NO: 905 - protein, 19 aa, Artificial Sequence
  candidate mimic peptide
IGLAVMGQNLILNMNDHGF

SEQ ID NO: 906 - protein, 10 aa, Artificial Sequence
  candidate mimic peptide
IGMPHRGRLN

SEQ ID NO: 907 - protein, 9 aa, Artificial Sequence
  candidate mimic peptide
IGSGGREHT

SEQ ID NO: 908 - protein, 12 aa, Artificial Sequence
  candidate mimic peptide
IGSGPGGYVAAI

SEQ ID NO: 909 - protein, 9 aa, Artificial Sequence
  candidate mimic peptide
IGSPPGYVG

SEQ ID NO: 910 - protein, 12 aa, Artificial Sequence
  candidate mimic peptide
IGSPPGYVGHEE

SEQ ID NO: 911 - protein, 9 aa, Artificial Sequence
  candidate mimic peptide
IGVLTSGGD

SEQ ID NO: 912 - protein, 10 aa, Artificial Sequence
  candidate mimic peptide
IGVLTSGGDA

SEQ ID NO: 913 - protein, 12 aa, Artificial Sequence
  candidate mimic peptide
IHARGPVGLEGL

SEQ ID NO: 914 - protein, 9 aa, Artificial Sequence
  candidate mimic peptide
IHDAVRPFV

SEQ ID NO: 915 - protein, 10 aa, Artificial Sequence
  candidate mimic peptide
IHDAVRPFVE

SEQ ID NO: 916 - protein, 10 aa, Artificial Sequence
  candidate mimic peptide
IHGSDSVESA

SEQ ID NO: 917 - protein, 14 aa, Artificial Sequence
  candidate mimic peptide
IIEPTSGNTGIGLA

SEQ ID NO: 918 - protein, 9 aa, Artificial Sequence
  candidate mimic peptide
IIFTSGGTE

SEQ ID NO: 919 - protein, 12 aa, Artificial Sequence
  candidate mimic peptide
IIGGGMAFTFLK

SEQ ID NO: 920 - protein, 9 aa, Artificial Sequence
  candidate mimic peptide
IILDEPTAG

SEQ ID NO: 921 - protein, 12 aa, Artificial Sequence
  candidate mimic peptide
IILLDEATSALD

SEQ ID NO: 922 - protein, 10 aa, Artificial Sequence
  candidate mimic peptide
IIPWNFPLLM

SEQ ID NO: 923 - protein, 12 aa, Artificial Sequence
  candidate mimic peptide
IITGPNMGGKST

SEQ ID NO: 924 - protein, 13 aa, Artificial Sequence
  candidate mimic peptide
IITGPNMGGKSTY

SEQ ID NO: 925 - protein, 9 aa, Artificial Sequence
  candidate mimic peptide
IIYTSGTTG

SEQ ID NO: 926 - protein, 14 aa, Artificial Sequence
  candidate mimic peptide
IIYTSGTTGRPKGV

SEQ ID NO: 927 - protein, 9 aa, Artificial Sequence
  candidate mimic peptide
IKAISFVGS

SEQ ID NO: 928 - protein, 11 aa, Artificial Sequence
  candidate mimic peptide
IKEGDIVKRTG

SEQ ID NO: 929 - protein, 9 aa, Artificial Sequence
  candidate mimic peptide
IKKAYRKLA

SEQ ID NO: 930 - protein, 15 aa, Artificial Sequence
  candidate mimic peptide
IKKAYRKMALKYHPD

SEQ ID NO: 931 - protein, 9 aa, Artificial Sequence
  candidate mimic peptide
IKKAYRRKA

SEQ ID NO: 932 - protein, 9 aa, Artificial Sequence
  candidate mimic peptide
IKPGAIVID

SEQ ID NO: 933 - protein, 9 aa, Artificial Sequence
  candidate mimic peptide
IKPGSMGKP

SEQ ID NO: 934 - protein, 9 aa, Artificial Sequence
  candidate mimic peptide
IKVGIGPGS

SEQ ID NO: 935 - protein, 9 aa, Artificial Sequence
  candidate mimic peptide
IKWNFTKFL

SEQ ID NO: 936 - protein, 11 aa, Artificial Sequence
  candidate mimic peptide
IKWNFTKFLID

SEQ ID NO: 937 - protein, 14 aa, Artificial Sequence
  candidate mimic peptide
ILCFYGPPGVGKTS

SEQ ID NO: 938 - protein, 9 aa, Artificial Sequence
  candidate mimic peptide
ILFIDEIHR

SEQ ID NO: 939 - protein, 9 aa, Artificial Sequence
  candidate mimic peptide
ILFSAHSLP

SEQ ID NO: 940 - protein, 9 aa, Artificial Sequence
  candidate mimic peptide
ILGHVQRGG

SEQ ID NO: 941 - protein, 9 aa, Artificial Sequence
  candidate mimic peptide
ILGQDPYHG

SEQ ID NO: 942 - protein, 10 aa, Artificial Sequence
  candidate mimic peptide
ILGQDPYHGP

SEQ ID NO: 943 - protein, 9 aa, Artificial Sequence
  candidate mimic peptide
ILILDEATS

SEQ ID NO: 944 - protein, 9 aa, Artificial Sequence
  candidate mimic peptide
ILITGGAGF

SEQ ID NO: 945 - protein, 9 aa, Artificial Sequence
  candidate mimic peptide
ILVDYSKNL

SEQ ID NO: 946 - protein, 16 aa, Artificial Sequence
  candidate mimic peptide
ILVFDLGGGTFDVSLL

SEQ ID NO: 947 - protein, 9 aa, Artificial Sequence
  candidate mimic peptide
ILVHGDAAF

SEQ ID NO: 948 - protein, 9 aa, Artificial Sequence
  candidate mimic peptide
ILYTSGTTG

SEQ ID NO: 949 - protein, 10 aa, Artificial Sequence
  candidate mimic peptide
IMIHQPSGGA

SEQ ID NO: 950 - protein, 11 aa, Artificial Sequence
  candidate mimic peptide
IMITPICPHSL

SEQ ID NO: 951 - protein, 9 aa, Artificial Sequence
  candidate mimic peptide
IMVARGDLG

SEQ ID NO: 952 - protein, 12 aa, Artificial Sequence
  candidate mimic peptide
IMVGPGTGIAPF

SEQ ID NO: 953 - protein, 12 aa, Artificial Sequence
  candidate mimic peptide
IMVGPGTGVAPF

SEQ ID NO: 954 - protein, 9 aa, Artificial Sequence
  candidate mimic peptide
INGFGRIGR

SEQ ID NO: 955 - protein, 10 aa, Artificial Sequence
  candidate mimic peptide
INGFGRIGRL

SEQ ID NO: 956 - protein, 13 aa, Artificial Sequence
  candidate mimic peptide
INIIDTPGHVDFT

SEQ ID NO: 957 - protein, 18 aa, Artificial Sequence
  candidate mimic peptide
INIIDTPGHVDFTIEVER

SEQ ID NO: 958 - protein, 21 aa, Artificial Sequence
  candidate mimic peptide
INIIDTPGHVDFTIEVERALR

SEQ ID NO: 959 - protein, 9 aa, Artificial Sequence
  candidate mimic peptide
INNAAGNFI

SEQ ID NO: 960 - protein, 13 aa, Artificial Sequence
  candidate mimic peptide
INSAVFPGLQGGP

SEQ ID NO: 961 - protein, 9 aa, Artificial Sequence
  candidate mimic peptide
IPDYRGPNG

SEQ ID NO: 962 - protein, 10 aa, Artificial Sequence
  candidate mimic peptide
IPHNGCRPRK

SEQ ID NO: 963 - protein, 11 aa, Artificial Sequence
  candidate mimic peptide
IPPPNVTGSLH

SEQ ID NO: 964 - protein, 15 aa, Artificial Sequence
  candidate mimic peptide
IPPPNVTGSLHLGHA

SEQ ID NO: 965 - protein, 9 aa, Artificial Sequence
  candidate mimic peptide
IPVIANGDI

SEQ ID NO: 966 - protein, 9 aa, Artificial Sequence
  candidate mimic peptide
IQFKLADMA

SEQ ID NO: 967 - protein, 9 aa, Artificial Sequence
  candidate mimic peptide
IQNALGSDI

SEQ ID NO: 968 - protein, 9 aa, Artificial Sequence
  candidate mimic peptide
IQVYEETSG

SEQ ID NO: 969 - protein, 11 aa, Artificial Sequence
  candidate mimic peptide
IRGHRRTYVGS

SEQ ID NO: 970 - protein, 9 aa, Artificial Sequence
  candidate mimic peptide
IRNFSIVAH

SEQ ID NO: 971 - protein, 10 aa, Artificial Sequence
  candidate mimic peptide
IRPRGGDFLY

SEQ ID NO: 972 - protein, 11 aa, Artificial Sequence
  candidate mimic peptide
IRPRGGDFLYS

SEQ ID NO: 973 - protein, 9 aa, Artificial Sequence
  candidate mimic peptide
IRTVMITGD

SEQ ID NO: 974 - protein, 10 aa, Artificial Sequence
  candidate mimic peptide
IRTVMITGDN

SEQ ID NO: 975 - protein, 9 aa, Artificial Sequence
  candidate mimic peptide
IRTVMVTGD

SEQ ID NO: 976 - protein, 16 aa, Artificial Sequence
  candidate mimic peptide
IRTYNFPQNRVTDHRI

SEQ ID NO: 977 - protein, 9 aa, Artificial Sequence
  candidate mimic peptide
ISGAHLNPA

SEQ ID NO: 978 - protein, 10 aa, Artificial Sequence
  candidate mimic peptide
ISGAHLNPAV

SEQ ID NO: 979 - protein, 10 aa, Artificial Sequence
  candidate mimic peptide
ISGGHFNPAV

SEQ ID NO: 980 - protein, 11 aa, Artificial Sequence
  candidate mimic peptide
ISGGHFNPAVS

SEQ ID NO: 981 - protein, 12 aa, Artificial Sequence
  candidate mimic peptide
ISGGHFNPAVSL

SEQ ID NO: 982 - protein, 9 aa, Artificial Sequence
  candidate mimic peptide
ISRQLWWGH

SEQ ID NO: 983 - protein, 13 aa, Artificial Sequence
  candidate mimic peptide
ISRQLWWGHRIPA

SEQ ID NO: 984 - protein, 9 aa, Artificial Sequence
  candidate mimic peptide
ITAQNHGYA

SEQ ID NO: 985 - protein, 10 aa, Artificial Sequence
  candidate mimic peptide
ITEIYEGTSE

SEQ ID NO: 986 - protein, 11 aa, Artificial Sequence
  candidate mimic peptide
ITEIYEGTSEI

SEQ ID NO: 987 - protein, 9 aa, Artificial Sequence
  candidate mimic peptide
ITGASSGIG

SEQ ID NO: 988 - protein, 10 aa, Artificial Sequence
  candidate mimic peptide
ITGASSGIGL

SEQ ID NO: 989 - protein, 11 aa, Artificial Sequence
  candidate mimic peptide
ITGPNMGGKST

SEQ ID NO: 990 - protein, 12 aa, Artificial Sequence
  candidate mimic peptide
ITGPNMGGKSTY

SEQ ID NO: 991 - protein, 12 aa, Artificial Sequence
  candidate mimic peptide
ITGPNMSGKSTY

SEQ ID NO: 992 - protein, 12 aa, Artificial Sequence
  candidate mimic peptide
ITKELIEIISGA

SEQ ID NO: 993 - protein, 10 aa, Artificial Sequence
  candidate mimic peptide
ITPTPLGEGK

SEQ ID NO: 994 - protein, 19 aa, Artificial Sequence
  candidate mimic peptide
ITPTPLGEGKSTTTIGLVQ

SEQ ID NO: 995 - protein, 9 aa, Artificial Sequence
  candidate mimic peptide
ITPVPGGVG

SEQ ID NO: 996 - protein, 10 aa, Artificial Sequence
  candidate mimic peptide
ITPVPGGVGP

SEQ ID NO: 997 - protein, 12 aa, Artificial Sequence
  candidate mimic peptide
ITPVPGGVGPMT

SEQ ID NO: 998 - protein, 17 aa, Artificial Sequence
  candidate mimic peptide
ITPVPGGVGPMTVAMLM

SEQ ID NO: 999 - protein, 13 aa, Artificial Sequence
  candidate mimic peptide
ITSCTNTSNPSVM

SEQ ID NO: 1000 - protein, 9 aa, Artificial Sequence
  candidate mimic peptide
ITVGILLSY

SEQ ID NO: 1001 - protein, 12 aa, Artificial Sequence
  candidate mimic peptide
ITVSEEVALKQA

SEQ ID NO: 1002 - protein, 9 aa, Artificial Sequence
  candidate mimic peptide
IVAGGDGTL

SEQ ID NO: 1003 - protein, 9 aa, Artificial Sequence
  candidate mimic peptide
IVEDIIDTG

SEQ ID NO: 1004 - protein, 9 aa, Artificial Sequence
  candidate mimic peptide
IVETEAYLG

SEQ ID NO: 1005 - protein, 10 aa, Artificial Sequence
  candidate mimic peptide
IVKYSPDCII

SEQ ID NO: 1006 - protein, 9 aa, Artificial Sequence
  candidate mimic peptide
IVLADADLD

SEQ ID NO: 1007 - protein, 12 aa, Artificial Sequence
  candidate mimic peptide
IVLMAQIGCFVP

SEQ ID NO: 1008 - protein, 11 aa, Artificial Sequence
  candidate mimic peptide
IVLVDDSIVRG

SEQ ID NO: 1009 - protein, 9 aa, Artificial Sequence
  candidate mimic peptide
IVNAANSSL

SEQ ID NO: 1010 - protein, 17 aa, Artificial Sequence
  candidate mimic peptide
IVNAANSSLLGGGGVDG

SEQ ID NO: 1011 - protein, 11 aa, Artificial Sequence
  candidate mimic peptide
IVSNASCTTNC

SEQ ID NO: 1012 - protein, 19 aa, Artificial Sequence
  candidate mimic peptide
IVSNASCTTNCLAPLAKVI

SEQ ID NO: 1013 - protein, 9 aa, Artificial Sequence
  candidate mimic peptide
IVVATPGRL

SEQ ID NO: 1014 - protein, 14 aa, Artificial Sequence
  candidate mimic peptide
IVVTDGERILGLGD

SEQ ID NO: 1015 - protein, 9 aa, Artificial Sequence
  candidate mimic peptide
IYAAGDICT

SEQ ID NO: 1016 - protein, 10 aa, Artificial Sequence
  candidate mimic peptide
IYARGAQDMK

SEQ ID NO: 1017 - protein, 11 aa, Artificial Sequence
  candidate mimic peptide
IYRIDHYLGKE

SEQ ID NO: 1018 - protein, 9 aa, Artificial Sequence
  candidate mimic peptide
KADIGIAMG

SEQ ID NO: 1019 - protein, 10 aa, Artificial Sequence
  candidate mimic peptide
KAEKNAVSHR

SEQ ID NO: 1020 - protein, 13 aa, Artificial Sequence
  candidate mimic peptide
KAFAAGADIKEMQ

SEQ ID NO: 1021 - protein, 9 aa, Artificial Sequence
  candidate mimic peptide
KAGRNRWLG

SEQ ID NO: 1022 - protein, 11 aa, Artificial Sequence
  candidate mimic peptide
KASGLAAGKGV

SEQ ID NO: 1023 - protein, 13 aa, Artificial Sequence
  candidate mimic peptide
KATSNICTAQALL

SEQ ID NO: 1024 - protein, 15 aa, Artificial Sequence
  candidate mimic peptide
KATSNICTAQALLAN

SEQ ID NO: 1025 - protein, 9 aa, Artificial Sequence
  candidate mimic peptide
KDDRTGTGT

SEQ ID NO: 1026 - protein, 9 aa, Artificial Sequence
  candidate mimic peptide
KDGEAVWFG

SEQ ID NO: 1027 - protein, 10 aa, Artificial Sequence
  candidate mimic peptide
KDGPLDMRMD

SEQ ID NO: 1028 - protein, 16 aa, Artificial Sequence
  candidate mimic peptide
KDVKVVILGQDPYHGP

SEQ ID NO: 1029 - protein, 21 aa, Artificial Sequence
  candidate mimic peptide
KDVKVVILGQDPYHGPNQAHG

SEQ ID NO: 1030 - protein, 22 aa, Artificial Sequence
  candidate mimic peptide
KDVKVVILGQDPYHGPNQAHGL

SEQ ID NO: 1031 - protein, 11 aa, Artificial Sequence
  candidate mimic peptide
KDYYEILGVSR

SEQ ID NO: 1032 - protein, 9 aa, Artificial Sequence
  candidate mimic peptide
KDYYKILGV

SEQ ID NO: 1033 - protein, 9 aa, Artificial Sequence
  candidate mimic peptide
KEEIFGPVL

SEQ ID NO: 1034 - protein, 9 aa, Artificial Sequence
  candidate mimic peptide
KEEIFGPVM

SEQ ID NO: 1035 - protein, 11 aa, Artificial Sequence
  candidate mimic peptide
KEGLALINGTQ

SEQ ID NO: 1036 - protein, 11 aa, Artificial Sequence
  candidate mimic peptide
KEIFLRELISN

SEQ ID NO: 1037 - protein, 15 aa, Artificial Sequence
  candidate mimic peptide
KEIFLRELISNASDA

SEQ ID NO: 1038 - protein, 9 aa, Artificial Sequence
  candidate mimic peptide
KERKGDYLG

SEQ ID NO: 1039 - protein, 9 aa, Artificial Sequence
  candidate mimic peptide
KERRGDYLG

SEQ ID NO: 1040 - protein, 9 aa, Artificial Sequence
  candidate mimic peptide
KEVILSGGA

SEQ ID NO: 1041 - protein, 11 aa, Artificial Sequence
  candidate mimic peptide
KEVTLLGQNVN

SEQ ID NO: 1042 - protein, 12 aa, Artificial Sequence
  candidate mimic peptide
KEVTLLGQNVNS

SEQ ID NO: 1043 - protein, 9 aa, Artificial Sequence
  candidate mimic peptide
KFYQASTSE

SEQ ID NO: 1044 - protein, 17 aa, Artificial Sequence
  candidate mimic peptide
KFYTEDGNWDLVGNNTP

SEQ ID NO: 1045 - protein, 9 aa, Artificial Sequence
  candidate mimic peptide
KGAMLTHGN

SEQ ID NO: 1046 - protein, 10 aa, Artificial Sequence
  candidate mimic peptide
KGILLYGPPG

SEQ ID NO: 1047 - protein, 11 aa, Artificial Sequence
  candidate mimic peptide
KGLYKKARAGE

SEQ ID NO: 1048 - protein, 12 aa, Artificial Sequence
  candidate mimic peptide
KGLYKKARAGEI

SEQ ID NO: 1049 - protein, 9 aa, Artificial Sequence
  candidate mimic peptide
KGRTPNPDI

SEQ ID NO: 1050 - protein, 9 aa, Artificial Sequence
  candidate mimic peptide
KGSLLWVLD

SEQ ID NO: 1051 - protein, 9 aa, Artificial Sequence
  candidate mimic peptide
KIDPYINID

SEQ ID NO: 1052 - protein, 11 aa, Artificial Sequence
  candidate mimic peptide
KIFITHLHGDH

SEQ ID NO: 1053 - protein, 9 aa, Artificial Sequence
  candidate mimic peptide
KIGHGGTLD

SEQ ID NO: 1054 - protein, 9 aa, Artificial Sequence
  candidate mimic peptide
KIIRKEIPA

SEQ ID NO: 1055 - protein, 9 aa, Artificial Sequence
  candidate mimic peptide
KILILDEAT

SEQ ID NO: 1056 - protein, 10 aa, Artificial Sequence
  candidate mimic peptide
KILNLRVFED

SEQ ID NO: 1057 - protein, 9 aa, Artificial Sequence
  candidate mimic peptide
KIRLTGGEP

SEQ ID NO: 1058 - protein, 10 aa, Artificial Sequence
  candidate mimic peptide
KIRLTGGEPL

SEQ ID NO: 1059 - protein, 13 aa, Artificial Sequence
  candidate mimic peptide
KIRLTGGEPLIRP

SEQ ID NO: 1060 - protein, 9 aa, Artificial Sequence
  candidate mimic peptide
KKLDVLSND

SEQ ID NO: 1061 - protein, 12 aa, Artificial Sequence
  candidate mimic peptide
KKRVFSGIQPTG

SEQ ID NO: 1062 - protein, 9 aa, Artificial Sequence
  candidate mimic peptide
KKVSLELGG

SEQ ID NO: 1063 - protein, 12 aa, Artificial Sequence
  candidate mimic peptide
KKVSLELGGKSP

SEQ ID NO: 1064 - protein, 9 aa, Artificial Sequence
  candidate mimic peptide
KKWCDDYFF

SEQ ID NO: 1065 - protein, 9 aa, Artificial Sequence
  candidate mimic peptide
KLAAFMKKF

SEQ ID NO: 1066 - protein, 9 aa, Artificial Sequence
  candidate mimic peptide
KLAKQYHPD

SEQ ID NO: 1067 - protein, 9 aa, Artificial Sequence
  candidate mimic peptide
KLAMKYHPD

SEQ ID NO: 1068 - protein, 9 aa, Artificial Sequence
  candidate mimic peptide
KLFVDTDAD

SEQ ID NO: 1069 - protein, 12 aa, Artificial Sequence
  candidate mimic peptide
KLHTGRSRNDQV

SEQ ID NO: 1070 - protein, 12 aa, Artificial Sequence
  candidate mimic peptide
KLSGGEKQRVAI

SEQ ID NO: 1071 - protein, 9 aa, Artificial Sequence
  candidate mimic peptide
KLTPNVTDI

SEQ ID NO: 1072 - protein, 10 aa, Artificial Sequence
  candidate mimic peptide
KLTPNVTDIV

SEQ ID NO: 1073 - protein, 12 aa, Artificial Sequence
  candidate mimic peptide
KLYVRRVFITDD

SEQ ID NO: 1074 - protein, 11 aa, Artificial Sequence
  candidate mimic peptide
KMKETAEAYLG

SEQ ID NO: 1075 - protein, 9 aa, Artificial Sequence
  candidate mimic peptide
KMSKSLGNV

SEQ ID NO: 1076 - protein, 10 aa, Artificial Sequence
  candidate mimic peptide
KMSKSLGNVI

SEQ ID NO: 1077 - protein, 12 aa, Artificial Sequence
  candidate mimic peptide
KMSKSLGNVVDP

SEQ ID NO: 1078 - protein, 9 aa, Artificial Sequence
  candidate mimic peptide
KMVHNGIEY

SEQ ID NO: 1079 - protein, 12 aa, Artificial Sequence
  candidate mimic peptide
KNRYVGRTFIQP

SEQ ID NO: 1080 - protein, 11 aa, Artificial Sequence
  candidate mimic peptide
KNTYGTGCFLL

SEQ ID NO: 1081 - protein, 10 aa, Artificial Sequence
  candidate mimic peptide
KPDILLLDEP

SEQ ID NO: 1082 - protein, 15 aa, Artificial Sequence
  candidate mimic peptide
KPHVNVGTIGHVDHG

SEQ ID NO: 1083 - protein, 10 aa, Artificial Sequence
  candidate mimic peptide
KPNIVLIMVD

SEQ ID NO: 1084 - protein, 9 aa, Artificial Sequence
  candidate mimic peptide
KPRYLMGVG

SEQ ID NO: 1085 - protein, 15 aa, Artificial Sequence
  candidate mimic peptide
KPVIAAVNGYAFGGG

SEQ ID NO: 1086 - protein, 9 aa, Artificial Sequence
  candidate mimic peptide
KQFTTVVAD

SEQ ID NO: 1087 - protein, 9 aa, Artificial Sequence
  candidate mimic peptide
KQRVAIARA

SEQ ID NO: 1088 - protein, 10 aa, Artificial Sequence
  candidate mimic peptide
KRIHEYKRQL

SEQ ID NO: 1089 - protein, 9 aa, Artificial Sequence
  candidate mimic peptide
KSGYGLDLE

SEQ ID NO: 1090 - protein, 11 aa, Artificial Sequence
  candidate mimic peptide
KSGYGLDLETE

SEQ ID NO: 1091 - protein, 11 aa, Artificial Sequence
  candidate mimic peptide
KSLDFYTRVLG

SEQ ID NO: 1092 - protein, 11 aa, Artificial Sequence
  candidate mimic peptide
KSNILLLGPTG

SEQ ID NO: 1093 - protein, 20 aa, Artificial Sequence
  candidate mimic peptide
KSNILLLGPTGSGKTLLAQT

SEQ ID NO: 1094 - protein, 22 aa, Artificial Sequence
  candidate mimic peptide
KSNILLLGPTGSGKTLLAQTLA

SEQ ID NO: 1095 - protein, 23 aa, Artificial Sequence
  candidate mimic peptide
KSNILLLGPTGSGKTLLAQTLAK

SEQ ID NO: 1096 - protein, 9 aa, Artificial Sequence
  candidate mimic peptide
KTFAYTNHT

SEQ ID NO: 1097 - protein, 13 aa, Artificial Sequence
  candidate mimic peptide
KTRLIGPNCPGVI

SEQ ID NO: 1098 - protein, 9 aa, Artificial Sequence
  candidate mimic peptide
KVEIAGPGF

SEQ ID NO: 1099 - protein, 11 aa, Artificial Sequence
  candidate mimic peptide
KVEIAGPGFIN

SEQ ID NO: 1100 - protein, 9 aa, Artificial Sequence
  candidate mimic peptide
KVFYVWFDA

SEQ ID NO: 1101 - protein, 10 aa, Artificial Sequence
  candidate mimic peptide
KVIDATGKLV

SEQ ID NO: 1102 - protein, 11 aa, Artificial Sequence
  candidate mimic peptide
KVLIANRGEIA

SEQ ID NO: 1103 - protein, 11 aa, Artificial Sequence
  candidate mimic peptide
KVVILGQDPYH

SEQ ID NO: 1104 - protein, 12 aa, Artificial Sequence
  candidate mimic peptide
KVVILGQDPYHG

SEQ ID NO: 1105 - protein, 13 aa, Artificial Sequence
  candidate mimic peptide
KVVILGQDPYHGP

SEQ ID NO: 1106 - protein, 19 aa, Artificial Sequence
  candidate mimic peptide
KVVILGQDPYHGPNQAHGL

SEQ ID NO: 1107 - protein, 9 aa, Artificial Sequence
  candidate mimic peptide
KYHPDKNPD

SEQ ID NO: 1108 - protein, 9 aa, Artificial Sequence
  candidate mimic peptide
LAAGNTVVI

SEQ ID NO: 1109 - protein, 9 aa, Artificial Sequence
  candidate mimic peptide
LAAQSIGEP

SEQ ID NO: 1110 - protein, 11 aa, Artificial Sequence
  candidate mimic peptide
LACARIGAIHS

SEQ ID NO: 1111 - protein, 10 aa, Artificial Sequence
  candidate mimic peptide
LADDMGLGKT

SEQ ID NO: 1112 - protein, 14 aa, Artificial Sequence
  candidate mimic peptide
LADYLVVNVSSPNT

SEQ ID NO: 1113 - protein, 9 aa, Artificial Sequence
  candidate mimic peptide
LASRDVVSR

SEQ ID NO: 1114 - protein, 10 aa, Artificial Sequence
  candidate mimic peptide
LATKAREGKL

SEQ ID NO: 1115 - protein, 10 aa, Artificial Sequence
  candidate mimic peptide
LAYEPVWAIG

SEQ ID NO: 1116 - protein, 15 aa, Artificial Sequence
  candidate mimic peptide
LAYEPVWAIGTGKTA

SEQ ID NO: 1117 - protein, 16 aa, Artificial Sequence
  candidate mimic peptide
LAYEPVWAIGTGKTAT

SEQ ID NO: 1118 - protein, 9 aa, Artificial Sequence
  candidate mimic peptide
LAYSGGLDT

SEQ ID NO: 1119 - protein, 10 aa, Artificial Sequence
  candidate mimic peptide
LAYSGGLDTS

SEQ ID NO: 1120 - protein, 12 aa, Artificial Sequence
  candidate mimic peptide
LDEADRMLDMGF

SEQ ID NO: 1121 - protein, 9 aa, Artificial Sequence
  candidate mimic peptide
LDEATSALD

SEQ ID NO: 1122 - protein, 10 aa, Artificial Sequence
  candidate mimic peptide
LDEPTAGLDP

SEQ ID NO: 1123 - protein, 9 aa, Artificial Sequence
  candidate mimic peptide
LDEPTNHLD

SEQ ID NO: 1124 - protein, 11 aa, Artificial Sequence
  candidate mimic peptide
LDGDNVRHGLN

SEQ ID NO: 1125 - protein, 12 aa, Artificial Sequence
  candidate mimic peptide
LDGDNVRHGLNR

SEQ ID NO: 1126 - protein, 10 aa, Artificial Sequence
  candidate mimic peptide
LDGGMGTMIQ

SEQ ID NO: 1127 - protein, 9 aa, Artificial Sequence
  candidate mimic peptide
LDIGTGTGL

SEQ ID NO: 1128 - protein, 9 aa, Artificial Sequence
  candidate mimic peptide
LDIPLLFET

SEQ ID NO: 1129 - protein, 10 aa, Artificial Sequence
  candidate mimic peptide
LDIPLLFETK

SEQ ID NO: 1130 - protein, 9 aa, Artificial Sequence
  candidate mimic peptide
LDKLRHTHV

SEQ ID NO: 1131 - protein, 10 aa, Artificial Sequence
  candidate mimic peptide
LDLCAAPGGK

SEQ ID NO: 1132 - protein, 17 aa, Artificial Sequence
  candidate mimic peptide
LDQLKQFTTVVADTGDF

SEQ ID NO: 1133 - protein, 9 aa, Artificial Sequence
  candidate mimic peptide
LDSARFRYF

SEQ ID NO: 1134 - protein, 9 aa, Artificial Sequence
  candidate mimic peptide
LDSARFRYL

SEQ ID NO: 1135 - protein, 10 aa, Artificial Sequence
  candidate mimic peptide
LDSRGNPTVE

SEQ ID NO: 1136 - protein, 11 aa, Artificial Sequence
  candidate mimic peptide
LDSRGNPTVEV

SEQ ID NO: 1137 - protein, 9 aa, Artificial Sequence
  candidate mimic peptide
LDTARFRFL

SEQ ID NO: 1138 - protein, 10 aa, Artificial Sequence
  candidate mimic peptide
LDTKGPEIRT

SEQ ID NO: 1139 - protein, 11 aa, Artificial Sequence
  candidate mimic peptide
LDTKGPEIRTG

SEQ ID NO: 1140 - protein, 13 aa, Artificial Sequence
  candidate mimic peptide
LDVAGGTGDIAFR

SEQ ID NO: 1141 - protein, 10 aa, Artificial Sequence
  candidate mimic peptide
LDVGCGSGIL

SEQ ID NO: 1142 - protein, 11 aa, Artificial Sequence
  candidate mimic peptide
LDVGCGSGILS

SEQ ID NO: 1143 - protein, 10 aa, Artificial Sequence
  candidate mimic peptide
LDVLINNAGI

SEQ ID NO: 1144 - protein, 9 aa, Artificial Sequence
  candidate mimic peptide
LDVLVNNAG

SEQ ID NO: 1145 - protein, 10 aa, Artificial Sequence
  candidate mimic peptide
LDVLVNNAGI

SEQ ID NO: 1146 - protein, 10 aa, Artificial Sequence
  candidate mimic peptide
LDYVDLYLLH

SEQ ID NO: 1147 - protein, 9 aa, Artificial Sequence
  candidate mimic peptide
LEFVQFHPT

SEQ ID NO: 1148 - protein, 10 aa, Artificial Sequence
  candidate mimic peptide
LEGHLRSILG

SEQ ID NO: 1149 - protein, 9 aa, Artificial Sequence
  candidate mimic peptide
LEINPLVVT

SEQ ID NO: 1150 - protein, 11 aa, Artificial Sequence
  candidate mimic peptide
LEINPLVVTKD

SEQ ID NO: 1151 - protein, 10 aa, Artificial Sequence
  candidate mimic peptide
LELGGKSPLI

SEQ ID NO: 1152 - protein, 9 aa, Artificial Sequence
  candidate mimic peptide
LELIASENF

SEQ ID NO: 1153 - protein, 12 aa, Artificial Sequence
  candidate mimic peptide
LELLEGKILPGV

SEQ ID NO: 1154 - protein, 9 aa, Artificial Sequence
  candidate mimic peptide
LELRVPFLD

SEQ ID NO: 1155 - protein, 10 aa, Artificial Sequence
  candidate mimic peptide
LEYRGYDSAG

SEQ ID NO: 1156 - protein, 10 aa, Artificial Sequence
  candidate mimic peptide
LFDEPTTGLD

SEQ ID NO: 1157 - protein, 9 aa, Artificial Sequence
  candidate mimic peptide
LFGTIDSWL

SEQ ID NO: 1158 - protein, 10 aa, Artificial Sequence
  candidate mimic peptide
LFTLAESLGG

SEQ ID NO: 1159 - protein, 10 aa, Artificial Sequence
  candidate mimic peptide
LFVGSEGTLG

SEQ ID NO: 1160 - protein, 9 aa, Artificial Sequence
  candidate mimic peptide
LGAGKTTLL

SEQ ID NO: 1161 - protein, 10 aa, Artificial Sequence
  candidate mimic peptide
LGAGKTTLLN

SEQ ID NO: 1162 - protein, 12 aa, Artificial Sequence
  candidate mimic peptide
LGAQWGDEGKGK

SEQ ID NO: 1163 - protein, 15 aa, Artificial Sequence
  candidate mimic peptide
LGDVYVNDAFGTAHR

SEQ ID NO: 1164 - protein, 9 aa, Artificial Sequence
  candidate mimic peptide
LGFPCNQFG

SEQ ID NO: 1165 - protein, 9 aa, Artificial Sequence
  candidate mimic peptide
LGGAKVADK

SEQ ID NO: 1166 - protein, 10 aa, Artificial Sequence
  candidate mimic peptide
LGGRVKTLHP

SEQ ID NO: 1167 - protein, 14 aa, Artificial Sequence
  candidate mimic peptide
LGGTCVNVGCVPKK

SEQ ID NO: 1168 - protein, 16 aa, Artificial Sequence
  candidate mimic peptide
LGGTCVNVGCVPKKVM

SEQ ID NO: 1169 - protein, 17 aa, Artificial Sequence
  candidate mimic peptide
LGGTCVNVGCVPKKVMW

SEQ ID NO: 1170 - protein, 15 aa, Artificial Sequence
  candidate mimic peptide
LGHVQRGGTPSAFDR

SEQ ID NO: 1171 - protein, 10 aa, Artificial Sequence
  candidate mimic peptide
LGLPTGSTPL

SEQ ID NO: 1172 - protein, 9 aa, Artificial Sequence
  candidate mimic peptide
LGMGADGHT

SEQ ID NO: 1173 - protein, 9 aa, Artificial Sequence
  candidate mimic peptide
LGNNKITDI

SEQ ID NO: 1174 - protein, 10 aa, Artificial Sequence
  candidate mimic peptide
LGPNGAGKST

SEQ ID NO: 1175 - protein, 10 aa, Artificial Sequence
  candidate mimic peptide
LGPNGAGKTT

SEQ ID NO: 1176 - protein, 12 aa, Artificial Sequence
  candidate mimic peptide
LGPNGAGKTTTI

SEQ ID NO: 1177 - protein, 12 aa, Artificial Sequence
  candidate mimic peptide
LGPPGAGKGTQA

SEQ ID NO: 1178 - protein, 10 aa, Artificial Sequence
  candidate mimic peptide
LGPPGSGKGT

SEQ ID NO: 1179 - protein, 9 aa, Artificial Sequence
  candidate mimic peptide
LGPTGSGKT

SEQ ID NO: 1180 - protein, 12 aa, Artificial Sequence
  candidate mimic peptide
LGPTGSGKTLLA

SEQ ID NO: 1181 - protein, 16 aa, Artificial Sequence
  candidate mimic peptide
LGPTGSGKTLLAQTLA

SEQ ID NO: 1182 - protein, 9 aa, Artificial Sequence
  candidate mimic peptide
LGRELGLPE

SEQ ID NO: 1183 - protein, 10 aa, Artificial Sequence
  candidate mimic peptide
LGRKSGKGFY

SEQ ID NO: 1184 - protein, 10 aa, Artificial Sequence
  candidate mimic peptide
LGSSQRFGVP

SEQ ID NO: 1185 - protein, 9 aa, Artificial Sequence
  candidate mimic peptide
LGSVGEPIN

SEQ ID NO: 1186 - protein, 9 aa, Artificial Sequence
  candidate mimic peptide
LGTHDFSAF

SEQ ID NO: 1187 - protein, 9 aa, Artificial Sequence
  candidate mimic peptide
LGVDKNASE

SEQ ID NO: 1188 - protein, 10 aa, Artificial Sequence
  candidate mimic peptide
LGVPFNIASY

SEQ ID NO: 1189 - protein, 13 aa, Artificial Sequence
  candidate mimic peptide
LGVPFNIASYALL

SEQ ID NO: 1190 - protein, 14 aa, Artificial Sequence
  candidate mimic peptide
LGVPFNIASYALLT

SEQ ID NO: 1191 - protein, 9 aa, Artificial Sequence
  candidate mimic peptide
LGVSRDASD

SEQ ID NO: 1192 - protein, 10 aa, Artificial Sequence
  candidate mimic peptide
LHDGPPYANG

SEQ ID NO: 1193 - protein, 11 aa, Artificial Sequence
  candidate mimic peptide
LHDGPPYANGD

SEQ ID NO: 1194 - protein, 10 aa, Artificial Sequence
  candidate mimic peptide
LHLGNYLGAI

SEQ ID NO: 1195 - protein, 10 aa, Artificial Sequence
  candidate mimic peptide
LHRAFSVFLF

SEQ ID NO: 1196 - protein, 11 aa, Artificial Sequence
  candidate mimic peptide
LHTGRSRNDQV

SEQ ID NO: 1197 - protein, 9 aa, Artificial Sequence
  candidate mimic peptide
LIANRGEIA

SEQ ID NO: 1198 - protein, 9 aa, Artificial Sequence
  candidate mimic peptide
LIASENFAS

SEQ ID NO: 1199 - protein, 9 aa, Artificial Sequence
  candidate mimic peptide
LIGADPREI

SEQ ID NO: 1200 - protein, 13 aa, Artificial Sequence
  candidate mimic peptide
LIGQFGVGFYSAF

SEQ ID NO: 1201 - protein, 11 aa, Artificial Sequence
  candidate mimic peptide
LILDEATSALD

SEQ ID NO: 1202 - protein, 9 aa, Artificial Sequence
  candidate mimic peptide
LILDEPTSG

SEQ ID NO: 1203 - protein, 12 aa, Artificial Sequence
  candidate mimic peptide
LISPFVGRILDW

SEQ ID NO: 1204 - protein, 11 aa, Artificial Sequence
  candidate mimic peptide
LITGASSGIGL

SEQ ID NO: 1205 - protein, 9 aa, Artificial Sequence
  candidate mimic peptide
LIYTSGTTG

SEQ ID NO: 1206 - protein, 9 aa, Artificial Sequence
  candidate mimic peptide
LKGHRSVGG

SEQ ID NO: 1207 - protein, 9 aa, Artificial Sequence
  candidate mimic peptide
LKGKQGRFR

SEQ ID NO: 1208 - protein, 9 aa, Artificial Sequence
  candidate mimic peptide
LKGRDLLTL

SEQ ID NO: 1209 - protein, 11 aa, Artificial Sequence
  candidate mimic peptide
LKLIADVGLVG

SEQ ID NO: 1210 - protein, 14 aa, Artificial Sequence
  candidate mimic peptide
LKLIADVGLVGFPN

SEQ ID NO: 1211 - protein, 9 aa, Artificial Sequence
  candidate mimic peptide
LKNDTFLRA

SEQ ID NO: 1212 - protein, 9 aa, Artificial Sequence
  candidate mimic peptide
LLAAGQSST

SEQ ID NO: 1213 - protein, 11 aa, Artificial Sequence
  candidate mimic peptide
LLDEPTAGLDP

SEQ ID NO: 1214 - protein, 9 aa, Artificial Sequence
  candidate mimic peptide
LLDGFPRTL

SEQ ID NO: 1215 - protein, 11 aa, Artificial Sequence
  candidate mimic peptide
LLDMKIFVDTD

SEQ ID NO: 1216 - protein, 14 aa, Artificial Sequence
  candidate mimic peptide
LLDVAGGTGDIAFR

SEQ ID NO: 1217 - protein, 9 aa, Artificial Sequence
  candidate mimic peptide
LLGGGGVDG

SEQ ID NO: 1218 - protein, 11 aa, Artificial Sequence
  candidate mimic peptide
LLGHNGAGKST

SEQ ID NO: 1219 - protein, 9 aa, Artificial Sequence
  candidate mimic peptide
LLGPNGAGK

SEQ ID NO: 1220 - protein, 11 aa, Artificial Sequence
  candidate mimic peptide
LLGPNGAGKST

SEQ ID NO: 1221 - protein, 12 aa, Artificial Sequence
  candidate mimic peptide
LLGPNGAGKTTT

SEQ ID NO: 1222 - protein, 13 aa, Artificial Sequence
  candidate mimic peptide
LLGPNGAGKTTTI

SEQ ID NO: 1223 - protein, 12 aa, Artificial Sequence
  candidate mimic peptide
LLGPPGAGKGTQ

SEQ ID NO: 1224 - protein, 13 aa, Artificial Sequence
  candidate mimic peptide
LLGPPGAGKGTQA

SEQ ID NO: 1225 - protein, 10 aa, Artificial Sequence
  candidate mimic peptide
LLHGDLWSGN

SEQ ID NO: 1226 - protein, 10 aa, Artificial Sequence
  candidate mimic peptide
LLHGFPEFWY

SEQ ID NO: 1227 - protein, 11 aa, Artificial Sequence
  candidate mimic peptide
LLLDEPTNHLD

SEQ ID NO: 1228 - protein, 12 aa, Artificial Sequence
  candidate mimic peptide
LLLDEPTNHLDL

SEQ ID NO: 1229 - protein, 14 aa, Artificial Sequence
  candidate mimic peptide
LLLDEPTNHLDLDA

SEQ ID NO: 1230 - protein, 10 aa, Artificial Sequence
  candidate mimic peptide
LLNYQTMVCD

SEQ ID NO: 1231 - protein, 16 aa, Artificial Sequence
  candidate mimic peptide
LLYGPPGCGKTLIAKA

SEQ ID NO: 1232 - protein, 10 aa, Artificial Sequence
  candidate mimic peptide
LMAKDLGLAQ

SEQ ID NO: 1233 - protein, 10 aa, Artificial Sequence
  candidate mimic peptide
LMAQIGCFVP

SEQ ID NO: 1234 - protein, 10 aa, Artificial Sequence
  candidate mimic peptide
LMKDAIKPNL

SEQ ID NO: 1235 - protein, 9 aa, Artificial Sequence
  candidate mimic peptide
LMRLDKPIG

SEQ ID NO: 1236 - protein, 10 aa, Artificial Sequence
  candidate mimic peptide
LMRLDKPIGT

SEQ ID NO: 1237 - protein, 9 aa, Artificial Sequence
  candidate mimic peptide
LNERHYGAL

SEQ ID NO: 1238 - protein, 9 aa, Artificial Sequence
  candidate mimic peptide
LNHASIIDG

SEQ ID NO: 1239 - protein, 12 aa, Artificial Sequence
  candidate mimic peptide
LNLIDTPGHVDF

SEQ ID NO: 1240 - protein, 9 aa, Artificial Sequence
  candidate mimic peptide
LNLRVFEDE

SEQ ID NO: 1241 - protein, 10 aa, Artificial Sequence
  candidate mimic peptide
LNPARDLGPR

SEQ ID NO: 1242 - protein, 10 aa, Artificial Sequence
  candidate mimic peptide
LNRKVLADLA

SEQ ID NO: 1243 - protein, 9 aa, Artificial Sequence
  candidate mimic peptide
LNRRKGPAV

SEQ ID NO: 1244 - protein, 9 aa, Artificial Sequence
  candidate mimic peptide
LPAGTYCDV

SEQ ID NO: 1245 - protein, 14 aa, Artificial Sequence
  candidate mimic peptide
LPDLGPIGANGLAN

SEQ ID NO: 1246 - protein, 9 aa, Artificial Sequence
  candidate mimic peptide
LPGTLPVLN

SEQ ID NO: 1247 - protein, 13 aa, Artificial Sequence
  candidate mimic peptide
LPGVGQNLQDHLE

SEQ ID NO: 1248 - protein, 9 aa, Artificial Sequence
  candidate mimic peptide
LPHIGSATH

SEQ ID NO: 1249 - protein, 11 aa, Artificial Sequence
  candidate mimic peptide
LPNSRIMIHQP

SEQ ID NO: 1250 - protein, 12 aa, Artificial Sequence
  candidate mimic peptide
LPVFLLGHSMGG

SEQ ID NO: 1251 - protein, 10 aa, Artificial Sequence
  candidate mimic peptide
LPVMVWIHGG

SEQ ID NO: 1252 - protein, 10 aa, Artificial Sequence
  candidate mimic peptide
LQRIYGISFP

SEQ ID NO: 1253 - protein, 10 aa, Artificial Sequence
  candidate mimic peptide
LQTREQHIRR

SEQ ID NO: 1254 - protein, 9 aa, Artificial Sequence
  candidate mimic peptide
LQYRYLDLR

SEQ ID NO: 1255 - protein, 12 aa, Artificial Sequence
  candidate mimic peptide
LRGRGGAGFPTG

SEQ ID NO: 1256 - protein, 11 aa, Artificial Sequence
  candidate mimic peptide
LRLQYRYLDLR

SEQ ID NO: 1257 - protein, 10 aa, Artificial Sequence
  candidate mimic peptide
LRPETAQGIF

SEQ ID NO: 1258 - protein, 10 aa, Artificial Sequence
  candidate mimic peptide
LRPHVVWFGE

SEQ ID NO: 1259 - protein, 9 aa, Artificial Sequence
  candidate mimic peptide
LRVFEDESG

SEQ ID NO: 1260 - protein, 10 aa, Artificial Sequence
  candidate mimic peptide
LRVVDASIMP

SEQ ID NO: 1261 - protein, 12 aa, Artificial Sequence
  candidate mimic peptide
LRYDLTVPFARY

SEQ ID NO: 1262 - protein, 9 aa, Artificial Sequence
  candidate mimic peptide
LSCQLYQRS

SEQ ID NO: 1263 - protein, 11 aa, Artificial Sequence
  candidate mimic peptide
LSCQLYQRSGD

SEQ ID NO: 1264 - protein, 13 aa, Artificial Sequence
  candidate mimic peptide
LSDELNHASIIDG

SEQ ID NO: 1265 - protein, 9 aa, Artificial Sequence
  candidate mimic peptide
LSGCGVYDG

SEQ ID NO: 1266 - protein, 9 aa, Artificial Sequence
  candidate mimic peptide
LSGGEKQRI

SEQ ID NO: 1267 - protein, 9 aa, Artificial Sequence
  candidate mimic peptide
LSGGQKQRI

SEQ ID NO: 1268 - protein, 14 aa, Artificial Sequence
  candidate mimic peptide
LSGGQKQRIAIARA

SEQ ID NO: 1269 - protein, 9 aa, Artificial Sequence
  candidate mimic peptide
LSGGQKQRL

SEQ ID NO: 1270 - protein, 9 aa, Artificial Sequence
  candidate mimic peptide
LSGGQKQRV

SEQ ID NO: 1271 - protein, 10 aa, Artificial Sequence
  candidate mimic peptide
LSGGQKQRVA

SEQ ID NO: 1272 - protein, 10 aa, Artificial Sequence
  candidate mimic peptide
LSGGQKQRVS

SEQ ID NO: 1273 - protein, 9 aa, Artificial Sequence
  candidate mimic peptide
LSGGQRQRI

SEQ ID NO: 1274 - protein, 9 aa, Artificial Sequence
  candidate mimic peptide
LSGGQRQRV

SEQ ID NO: 1275 - protein, 11 aa, Artificial Sequence
  candidate mimic peptide
LSGGVDSAVAA

SEQ ID NO: 1276 - protein, 9 aa, Artificial Sequence
  candidate mimic peptide
LSGGVDSTV

SEQ ID NO: 1277 - protein, 12 aa, Artificial Sequence
  candidate mimic peptide
LSGHTHAGQIFP

SEQ ID NO: 1278 - protein, 12 aa, Artificial Sequence
  candidate mimic peptide
LSGPSGAGKSTL

SEQ ID NO: 1279 - protein, 9 aa, Artificial Sequence
  candidate mimic peptide
LSIPVIANG

SEQ ID NO: 1280 - protein, 16 aa, Artificial Sequence
  candidate mimic peptide
LSMANAGPNTNGSQFF

SEQ ID NO: 1281 - protein, 17 aa, Artificial Sequence
  candidate mimic peptide
LSMANAGPNTNGSQFFI

SEQ ID NO: 1282 - protein, 9 aa, Artificial Sequence
  candidate mimic peptide
LSMFPYPSG

SEQ ID NO: 1283 - protein, 17 aa, Artificial Sequence
  candidate mimic peptide
LSMFPYPSGKLHMGHVR

SEQ ID NO: 1284 - protein, 9 aa, Artificial Sequence
  candidate mimic peptide
LSPNGGGEP

SEQ ID NO: 1285 - protein, 9 aa, Artificial Sequence
  candidate mimic peptide
LSQSGETAD

SEQ ID NO: 1286 - protein, 11 aa, Artificial Sequence
  candidate mimic peptide
LSQSGETADTL

SEQ ID NO: 1287 - protein, 11 aa, Artificial Sequence
  candidate mimic peptide
LSVAVYNHYKR

SEQ ID NO: 1288 - protein, 12 aa, Artificial Sequence
  candidate mimic peptide
LSVAVYNHYKRI

SEQ ID NO: 1289 - protein, 10 aa, Artificial Sequence
  candidate mimic peptide
LTASAGIAPN

SEQ ID NO: 1290 - protein, 10 aa, Artificial Sequence
  candidate mimic peptide
LTDYGFEGHP

SEQ ID NO: 1291 - protein, 9 aa, Artificial Sequence
  candidate mimic peptide
LTIRLALGG

SEQ ID NO: 1292 - protein, 12 aa, Artificial Sequence
  candidate mimic peptide
LTPTRELAVQVK

SEQ ID NO: 1293 - protein, 13 aa, Artificial Sequence
  candidate mimic peptide
LTPVTLELGGKSP

SEQ ID NO: 1294 - protein, 9 aa, Artificial Sequence
  candidate mimic peptide
LTRLDHNRA

SEQ ID NO: 1295 - protein, 10 aa, Artificial Sequence
  candidate mimic peptide
LTRLDHNRAK

SEQ ID NO: 1296 - protein, 9 aa, Artificial Sequence
  candidate mimic peptide
LTTGTFLRG

SEQ ID NO: 1297 - protein, 11 aa, Artificial Sequence
  candidate mimic peptide
LTYPLIGNYGI

SEQ ID NO: 1298 - protein, 9 aa, Artificial Sequence
  candidate mimic peptide
LVDDSIVRG

SEQ ID NO: 1299 - protein, 9 aa, Artificial Sequence
  candidate mimic peptide
LVDGKDVMP

SEQ ID NO: 1300 - protein, 12 aa, Artificial Sequence
  candidate mimic peptide
LVDGKDVMPEVN

SEQ ID NO: 1301 - protein, 9 aa, Artificial Sequence
  candidate mimic peptide
LVEFMASGP

SEQ ID NO: 1302 - protein, 11 aa, Artificial Sequence
  candidate mimic peptide
LVEVNCETDFV

SEQ ID NO: 1303 - protein, 12 aa, Artificial Sequence
  candidate mimic peptide
LVEVNCETDFVS

SEQ ID NO: 1304 - protein, 10 aa, Artificial Sequence
  candidate mimic peptide
LVGDVDFEGV

SEQ ID NO: 1305 - protein, 9 aa, Artificial Sequence
  candidate mimic peptide
LVGGASLKP

SEQ ID NO: 1306 - protein, 12 aa, Artificial Sequence
  candidate mimic peptide
LVGGFGLCGIPE

SEQ ID NO: 1307 - protein, 9 aa, Artificial Sequence
  candidate mimic peptide
LVGGSTRIP

SEQ ID NO: 1308 - protein, 9 aa, Artificial Sequence
  candidate mimic peptide
LVIFPEGTR

SEQ ID NO: 1309 - protein, 11 aa, Artificial Sequence
  candidate mimic peptide
LVLEVAQHLGE

SEQ ID NO: 1310 - protein, 10 aa, Artificial Sequence
  candidate mimic peptide
LVLTHFSQRY

SEQ ID NO: 1311 - protein, 9 aa, Artificial Sequence
  candidate mimic peptide
LVLTKPLGT

SEQ ID NO: 1312 - protein, 10 aa, Artificial Sequence
  candidate mimic peptide
LVLTPTRELA

SEQ ID NO: 1313 - protein, 14 aa, Artificial Sequence
  candidate mimic peptide
LVLTPTRELAVQVK

SEQ ID NO: 1314 - protein, 9 aa, Artificial Sequence
  candidate mimic peptide
LVNIFGGIV

SEQ ID NO: 1315 - protein, 11 aa, Artificial Sequence
  candidate mimic peptide
LVPIGRGQREL

SEQ ID NO: 1316 - protein, 15 aa, Artificial Sequence
  candidate mimic peptide
LVPIGRGQRELIIGD

SEQ ID NO: 1317 - protein, 16 aa, Artificial Sequence
  candidate mimic peptide
LVPIGRGQRELIIGDR

SEQ ID NO: 1318 - protein, 21 aa, Artificial Sequence
  candidate mimic peptide
LVPIGRGQRELIIGDRQTGKT

SEQ ID NO: 1319 - protein, 22 aa, Artificial Sequence
  candidate mimic peptide
LVPIGRGQRELIIGDRQTGKTS

SEQ ID NO: 1320 - protein, 9 aa, Artificial Sequence
  candidate mimic peptide
LVQLPLPEH

SEQ ID NO: 1321 - protein, 10 aa, Artificial Sequence
  candidate mimic peptide
LVQLPLPEHI

SEQ ID NO: 1322 - protein, 11 aa, Artificial Sequence
  candidate mimic peptide
LVQLPLPEHID

SEQ ID NO: 1323 - protein, 13 aa, Artificial Sequence
  candidate mimic peptide
LVSGGTDNHLVLV

SEQ ID NO: 1324 - protein, 9 aa, Artificial Sequence
  candidate mimic peptide
LVTGGAGFI

SEQ ID NO: 1325 - protein, 13 aa, Artificial Sequence
  candidate mimic peptide
LVTGGAGYIGSHT

SEQ ID NO: 1326 - protein, 14 aa, Artificial Sequence
  candidate mimic peptide
LVTGGAGYIGSHTV

SEQ ID NO: 1327 - protein, 15 aa, Artificial Sequence
  candidate mimic peptide
LVTGGAGYIGSHTVL

SEQ ID NO: 1328 - protein, 9 aa, Artificial Sequence
  candidate mimic peptide
LVVIDSVAA

SEQ ID NO: 1329 - protein, 10 aa, Artificial Sequence
  candidate mimic peptide
LWDAIVIGAG

SEQ ID NO: 1330 - protein, 9 aa, Artificial Sequence
  candidate mimic peptide
LWEAQFGDF

SEQ ID NO: 1331 - protein, 9 aa, Artificial Sequence
  candidate mimic peptide
LYAEQLSGS

SEQ ID NO: 1332 - protein, 12 aa, Artificial Sequence
  candidate mimic peptide
LYAEQLSGSAFT

SEQ ID NO: 1333 - protein, 9 aa, Artificial Sequence
  candidate mimic peptide
LYDTYGFPV

SEQ ID NO: 1334 - protein, 11 aa, Artificial Sequence
  candidate mimic peptide
LYMTRIQKERF

SEQ ID NO: 1335 - protein, 10 aa, Artificial Sequence
  candidate mimic peptide
LYVRRVFITD

SEQ ID NO: 1336 - protein, 9 aa, Artificial Sequence
  candidate mimic peptide
LYWLSGLTC

SEQ ID NO: 1337 - protein, 9 aa, Artificial Sequence
  candidate mimic peptide
MALPPCHAL

SEQ ID NO: 1338 - protein, 9 aa, Artificial Sequence
  candidate mimic peptide
MAQIGCFVP

SEQ ID NO: 1339 - protein, 10 aa, Artificial Sequence
  candidate mimic peptide
MASGPVVAMV

SEQ ID NO: 1340 - protein, 9 aa, Artificial Sequence
  candidate mimic peptide
MEALNVLPP

SEQ ID NO: 1341 - protein, 9 aa, Artificial Sequence
  candidate mimic peptide
MGCSNPHPH

SEQ ID NO: 1342 - protein, 9 aa, Artificial Sequence
  candidate mimic peptide
MGGQTALNC

SEQ ID NO: 1343 - protein, 9 aa, Artificial Sequence
  candidate mimic peptide
MGHGDEIVL

SEQ ID NO: 1344 - protein, 11 aa, Artificial Sequence
  candidate mimic peptide
MGHGDEIVLAD

SEQ ID NO: 1345 - protein, 9 aa, Artificial Sequence
  candidate mimic peptide
MGHVDHGKT

SEQ ID NO: 1346 - protein, 14 aa, Artificial Sequence
  candidate mimic peptide
MGHVDHGKTTLLDK

SEQ ID NO: 1347 - protein, 9 aa, Artificial Sequence
  candidate mimic peptide
MGKIDKKAL

SEQ ID NO: 1348 - protein, 9 aa, Artificial Sequence
  candidate mimic peptide
MGPLGSPLS

SEQ ID NO: 1349 - protein, 9 aa, Artificial Sequence
  candidate mimic peptide
MGVSGSGKS

SEQ ID NO: 1350 - protein, 9 aa, Artificial Sequence
  candidate mimic peptide
MIRPRGGDF

SEQ ID NO: 1351 - protein, 9 aa, Artificial Sequence
  candidate mimic peptide
MITASHNPK

SEQ ID NO: 1352 - protein, 9 aa, Artificial Sequence
  candidate mimic peptide
MITGDNPLT

SEQ ID NO: 1353 - protein, 9 aa, Artificial Sequence
  candidate mimic peptide
MKSVGEVMA

SEQ ID NO: 1354 - protein, 14 aa, Artificial Sequence
  candidate mimic peptide
MKSVGEVMAIGRTF

SEQ ID NO: 1355 - protein, 9 aa, Artificial Sequence
  candidate mimic peptide
MKVRGAPAI

SEQ ID NO: 1356 - protein, 9 aa, Artificial Sequence
  candidate mimic peptide
MLACARIGA

SEQ ID NO: 1357 - protein, 12 aa, Artificial Sequence
  candidate mimic peptide
MLLLDEPTNHLD

SEQ ID NO: 1358 - protein, 11 aa, Artificial Sequence
  candidate mimic peptide
MLQQTQVATVI

SEQ ID NO: 1359 - protein, 9 aa, Artificial Sequence
  candidate mimic peptide
MLTGESIPV

SEQ ID NO: 1360 - protein, 12 aa, Artificial Sequence
  candidate mimic peptide
MPTGGGKSLCYQ

SEQ ID NO: 1361 - protein, 9 aa, Artificial Sequence
  candidate mimic peptide
MQEEIFGPV

SEQ ID NO: 1362 - protein, 9 aa, Artificial Sequence
  candidate mimic peptide
MQKEIFEQP

SEQ ID NO: 1363 - protein, 9 aa, Artificial Sequence
  candidate mimic peptide
MRQAGRYLP

SEQ ID NO: 1364 - protein, 10 aa, Artificial Sequence
  candidate mimic peptide
MRQAGRYLPE

SEQ ID NO: 1365 - protein, 10 aa, Artificial Sequence
  candidate mimic peptide
MRVDFNVPMK

SEQ ID NO: 1366 - protein, 9 aa, Artificial Sequence
  candidate mimic peptide
MTFGLACCA

SEQ ID NO: 1367 - protein, 12 aa, Artificial Sequence
  candidate mimic peptide
MTFGLACCAVEM

SEQ ID NO: 1368 - protein, 13 aa, Artificial Sequence
  candidate mimic peptide
MTFGLACCAVEMM

SEQ ID NO: 1369 - protein, 10 aa, Artificial Sequence
  candidate mimic peptide
MTVEPGFGGQ

SEQ ID NO: 1370 - protein, 10 aa, Artificial Sequence
  candidate mimic peptide
MVYVRGHAED

SEQ ID NO: 1371 - protein, 10 aa, Artificial Sequence
  candidate mimic peptide
MYCTGGIRCE

SEQ ID NO: 1372 - protein, 9 aa, Artificial Sequence
  candidate mimic peptide
MYGQMTAGS

SEQ ID NO: 1373 - protein, 14 aa, Artificial Sequence
  candidate mimic peptide
MYTSGSTGRPKGVM

SEQ ID NO: 1374 - protein, 12 aa, Artificial Sequence
  candidate mimic peptide
NANGVDLNRNFP

SEQ ID NO: 1375 - protein, 10 aa, Artificial Sequence
  candidate mimic peptide
NASGINDGAA

SEQ ID NO: 1376 - protein, 11 aa, Artificial Sequence
  candidate mimic peptide
NASGINDGAAA

SEQ ID NO: 1377 - protein, 12 aa, Artificial Sequence
  candidate mimic peptide
NASGINDGAAAV

SEQ ID NO: 1378 - protein, 11 aa, Artificial Sequence
  candidate mimic peptide
NASRTMLFNIH

SEQ ID NO: 1379 - protein, 9 aa, Artificial Sequence
  candidate mimic peptide
NASTRFSDG

SEQ ID NO: 1380 - protein, 10 aa, Artificial Sequence
  candidate mimic peptide
NCETDFVSRN

SEQ ID NO: 1381 - protein, 10 aa, Artificial Sequence
  candidate mimic peptide
NCNPETVSTD

SEQ ID NO: 1382 - protein, 9 aa, Artificial Sequence
  candidate mimic peptide
NDAFGTAHR

SEQ ID NO: 1383 - protein, 11 aa, Artificial Sequence
  candidate mimic peptide
NDAFGTAHRAH

SEQ ID NO: 1384 - protein, 11 aa, Artificial Sequence
  candidate mimic peptide
NDNLMELLIMI

SEQ ID NO: 1385 - protein, 9 aa, Artificial Sequence
  candidate mimic peptide
NERLEFLGD

SEQ ID NO: 1386 - protein, 10 aa, Artificial Sequence
  candidate mimic peptide
NERLEFLGDA

SEQ ID NO: 1387 - protein, 11 aa, Artificial Sequence
  candidate mimic peptide
NERLEFLGDAV

SEQ ID NO: 1388 - protein, 9 aa, Artificial Sequence
  candidate mimic peptide
NEWDPLEEV

SEQ ID NO: 1389 - protein, 12 aa, Artificial Sequence
  candidate mimic peptide
NEWDPLEEVIVG

SEQ ID NO: 1390 - protein, 10 aa, Artificial Sequence
  candidate mimic peptide
NFCANNYLGL

SEQ ID NO: 1391 - protein, 14 aa, Artificial Sequence
  candidate mimic peptide
NFGPQHPAAHGVLR

SEQ ID NO: 1392 - protein, 15 aa, Artificial Sequence
  candidate mimic peptide
NFGPQHPAAHGVLRL

SEQ ID NO: 1393 - protein, 16 aa, Artificial Sequence
  candidate mimic peptide
NFGPQHPAAHGVLRLV

SEQ ID NO: 1394 - protein, 10 aa, Artificial Sequence
  candidate mimic peptide
NGAFTGEISP

SEQ ID NO: 1395 - protein, 9 aa, Artificial Sequence
  candidate mimic peptide
NGAGKSTLL

SEQ ID NO: 1396 - protein, 9 aa, Artificial Sequence
  candidate mimic peptide
NGAGKSTTI

SEQ ID NO: 1397 - protein, 9 aa, Artificial Sequence
  candidate mimic peptide
NGAGKTTTF

SEQ ID NO: 1398 - protein, 9 aa, Artificial Sequence
  candidate mimic peptide
NGAGKTTTI

SEQ ID NO: 1399 - protein, 10 aa, Artificial Sequence
  candidate mimic peptide
NGIVHRDIKP

SEQ ID NO: 1400 - protein, 11 aa, Artificial Sequence
  candidate mimic peptide
NGKDYYFVTRE

SEQ ID NO: 1401 - protein, 11 aa, Artificial Sequence
  candidate mimic peptide
NGKVALVTGAA

SEQ ID NO: 1402 - protein, 10 aa, Artificial Sequence
  candidate mimic peptide
NGLANPRDFL

SEQ ID NO: 1403 - protein, 10 aa, Artificial Sequence
  candidate mimic peptide
NGMDVFRVFD

SEQ ID NO: 1404 - protein, 13 aa, Artificial Sequence
  candidate mimic peptide
NGNEIGGGSIRIH

SEQ ID NO: 1405 - protein, 9 aa, Artificial Sequence
  candidate mimic peptide
NHPDLRRIL

SEQ ID NO: 1406 - protein, 14 aa, Artificial Sequence
  candidate mimic peptide
NHPDLRRILTDYGF

SEQ ID NO: 1407 - protein, 10 aa, Artificial Sequence
  candidate mimic peptide
NIGIGGSDLG

SEQ ID NO: 1408 - protein, 11 aa, Artificial Sequence
  candidate mimic peptide
NIGIGGSDLGP

SEQ ID NO: 1409 - protein, 12 aa, Artificial Sequence
  candidate mimic peptide
NIIDTPGHVDFT

SEQ ID NO: 1410 - protein, 15 aa, Artificial Sequence
  candidate mimic peptide
NIIDTPGHVDFTIEV

SEQ ID NO: 1411 - protein, 17 aa, Artificial Sequence
  candidate mimic peptide
NIIDTPGHVDFTIEVER

SEQ ID NO: 1412 - protein, 10 aa, Artificial Sequence
  candidate mimic peptide
NIRNFSIVAH

SEQ ID NO: 1413 - protein, 9 aa, Artificial Sequence
  candidate mimic peptide
NKEIFLREL

SEQ ID NO: 1414 - protein, 13 aa, Artificial Sequence
  candidate mimic peptide
NKEIFLRELISNA

SEQ ID NO: 1415 - protein, 16 aa, Artificial Sequence
  candidate mimic peptide
NKEIFLRELISNASDA

SEQ ID NO: 1416 - protein, 19 aa, Artificial Sequence
  candidate mimic peptide
NKEIFLRELISNASDALDK

SEQ ID NO: 1417 - protein, 9 aa, Artificial Sequence
  candidate mimic peptide
NKEPGAEEK

SEQ ID NO: 1418 - protein, 9 aa, Artificial Sequence
  candidate mimic peptide
NKYSEGYPG

SEQ ID NO: 1419 - protein, 9 aa, Artificial Sequence
  candidate mimic peptide
NLDEFAMGS

SEQ ID NO: 1420 - protein, 9 aa, Artificial Sequence
  candidate mimic peptide
NLFAIIQGG

SEQ ID NO: 1421 - protein, 9 aa, Artificial Sequence
  candidate mimic peptide
NLGFSPEDR

SEQ ID NO: 1422 - protein, 10 aa, Artificial Sequence
  candidate mimic peptide
NLIGEHTDYN

SEQ ID NO: 1423 - protein, 9 aa, Artificial Sequence
  candidate mimic peptide
NLMELLIMI

SEQ ID NO: 1424 - protein, 9 aa, Artificial Sequence
  candidate mimic peptide
NLSGGQKQR

SEQ ID NO: 1425 - protein, 10 aa, Artificial Sequence
  candidate mimic peptide
NLSPNGGGEP

SEQ ID NO: 1426 - protein, 9 aa, Artificial Sequence
  candidate mimic peptide
NMILDDGGD

SEQ ID NO: 1427 - protein, 9 aa, Artificial Sequence
  candidate mimic peptide
NPAFDVTPH

SEQ ID NO: 1428 - protein, 9 aa, Artificial Sequence
  candidate mimic peptide
NPETVSTDF

SEQ ID NO: 1429 - protein, 10 aa, Artificial Sequence
  candidate mimic peptide
NPETVSTDFD

SEQ ID NO: 1430 - protein, 11 aa, Artificial Sequence
  candidate mimic peptide
NPFDLTKVWPH

SEQ ID NO: 1431 - protein, 11 aa, Artificial Sequence
  candidate mimic peptide
NPGDGAFYGPK

SEQ ID NO: 1432 - protein, 9 aa, Artificial Sequence
  candidate mimic peptide
NPTYKEVCS

SEQ ID NO: 1433 - protein, 9 aa, Artificial Sequence
  candidate mimic peptide
NPVDILTYV

SEQ ID NO: 1434 - protein, 12 aa, Artificial Sequence
  candidate mimic peptide
NPVPVMKLVEVI

SEQ ID NO: 1435 - protein, 9 aa, Artificial Sequence
  candidate mimic peptide
NQIVHRDIK

SEQ ID NO: 1436 - protein, 11 aa, Artificial Sequence
  candidate mimic peptide
NQRETTVIWDK

SEQ ID NO: 1437 - protein, 9 aa, Artificial Sequence
  candidate mimic peptide
NQRETTVVW

SEQ ID NO: 1438 - protein, 10 aa, Artificial Sequence
  candidate mimic peptide
NQRETTVVWD

SEQ ID NO: 1439 - protein, 11 aa, Artificial Sequence
  candidate mimic peptide
NQRETTVVWDK

SEQ ID NO: 1440 - protein, 9 aa, Artificial Sequence
  candidate mimic peptide
NRDHRKIGK

SEQ ID NO: 1441 - protein, 9 aa, Artificial Sequence
  candidate mimic peptide
NRKVLADLA

SEQ ID NO: 1442 - protein, 9 aa, Artificial Sequence
  candidate mimic peptide
NRLGANSLL

SEQ ID NO: 1443 - protein, 9 aa, Artificial Sequence
  candidate mimic peptide
NRPKALNAL

SEQ ID NO: 1444 - protein, 9 aa, Artificial Sequence
  candidate mimic peptide
NRSASIRIP

SEQ ID NO: 1445 - protein, 12 aa, Artificial Sequence
  candidate mimic peptide
NSAVFPGLQGGP

SEQ ID NO: 1446 - protein, 12 aa, Artificial Sequence
  candidate mimic peptide
NSFGFGGTNATL

SEQ ID NO: 1447 - protein, 10 aa, Artificial Sequence
  candidate mimic peptide
NTARGGLVDE

SEQ ID NO: 1448 - protein, 10 aa, Artificial Sequence
  candidate mimic peptide
NTDAEGRLIL

SEQ ID NO: 1449 - protein, 13 aa, Artificial Sequence
  candidate mimic peptide
NTDAEGRLILADA

SEQ ID NO: 1450 - protein, 10 aa, Artificial Sequence
  candidate mimic peptide
NTDAEGRLVL

SEQ ID NO: 1451 - protein, 12 aa, Artificial Sequence
  candidate mimic peptide
NTDAEGRLVLAD

SEQ ID NO: 1452 - protein, 13 aa, Artificial Sequence
  candidate mimic peptide
NTDAEGRLVLADG

SEQ ID NO: 1453 - protein, 14 aa, Artificial Sequence
  candidate mimic peptide
NTDAEGRLVLADGV

SEQ ID NO: 1454 - protein, 16 aa, Artificial Sequence
  candidate mimic peptide
NTDNMSILGLTIDYGP

SEQ ID NO: 1455 - protein, 9 aa, Artificial Sequence
  candidate mimic peptide
NTFVAELKG

SEQ ID NO: 1456 - protein, 9 aa, Artificial Sequence
  candidate mimic peptide
NVGKSSIIN

SEQ ID NO: 1457 - protein, 11 aa, Artificial Sequence
  candidate mimic peptide
NVGKSSIINSL

SEQ ID NO: 1458 - protein, 9 aa, Artificial Sequence
  candidate mimic peptide
NVGKSSLIN

SEQ ID NO: 1459 - protein, 11 aa, Artificial Sequence
  candidate mimic peptide
NVGKSSLINGL

SEQ ID NO: 1460 - protein, 11 aa, Artificial Sequence
  candidate mimic peptide
NVGKSSLINSL

SEQ ID NO: 1461 - protein, 11 aa, Artificial Sequence
  candidate mimic peptide
NVGTIGHVDHG

SEQ ID NO: 1462 - protein, 9 aa, Artificial Sequence
  candidate mimic peptide
PAKSGVAGG

SEQ ID NO: 1463 - protein, 10 aa, Artificial Sequence
  candidate mimic peptide
PAKSGVAGGI

SEQ ID NO: 1464 - protein, 9 aa, Artificial Sequence
  candidate mimic peptide
PCGACRQVM

SEQ ID NO: 1465 - protein, 9 aa, Artificial Sequence
  candidate mimic peptide
PCGTTIGPI

SEQ ID NO: 1466 - protein, 10 aa, Artificial Sequence
  candidate mimic peptide
PDGGIARLRV

SEQ ID NO: 1467 - protein, 9 aa, Artificial Sequence
  candidate mimic peptide
PDGGVSRLR

SEQ ID NO: 1468 - protein, 10 aa, Artificial Sequence
  candidate mimic peptide
PDGGVSRLRL

SEQ ID NO: 1469 - protein, 9 aa, Artificial Sequence
  candidate mimic peptide
PDIVTMAKG

SEQ ID NO: 1470 - protein, 9 aa, Artificial Sequence
  candidate mimic peptide
PDKDVDGFH

SEQ ID NO: 1471 - protein, 12 aa, Artificial Sequence
  candidate mimic peptide
PDNYKVIFLQGG

SEQ ID NO: 1472 - protein, 9 aa, Artificial Sequence
  candidate mimic peptide
PEEKRKIIG

SEQ ID NO: 1473 - protein, 13 aa, Artificial Sequence
  candidate mimic peptide
PEGATPKDGPSAG

SEQ ID NO: 1474 - protein, 9 aa, Artificial Sequence
  candidate mimic peptide
PEGLAVSLP

SEQ ID NO: 1475 - protein, 9 aa, Artificial Sequence
  candidate mimic peptide
PEKDVDGFH

SEQ ID NO: 1476 - protein, 12 aa, Artificial Sequence
  candidate mimic peptide
PERVVHAKGAGA

SEQ ID NO: 1477 - protein, 9 aa, Artificial Sequence
  candidate mimic peptide
PFDLTKVWP

SEQ ID NO: 1478 - protein, 9 aa, Artificial Sequence
  candidate mimic peptide
PFGGFKMSG

SEQ ID NO: 1479 - protein, 9 aa, Artificial Sequence
  candidate mimic peptide
PFGGVGASG

SEQ ID NO: 1480 - protein, 9 aa, Artificial Sequence
  candidate mimic peptide
PFGGYKKSG

SEQ ID NO: 1481 - protein, 14 aa, Artificial Sequence
  candidate mimic peptide
PFNFPAMIPLWMFP

SEQ ID NO: 1482 - protein, 10 aa, Artificial Sequence
  candidate mimic peptide
PFNIASYALL

SEQ ID NO: 1483 - protein, 10 aa, Artificial Sequence
  candidate mimic peptide
PFPGPGLAIR

SEQ ID NO: 1484 - protein, 11 aa, Artificial Sequence
  candidate mimic peptide
PFPGPGLAIRV

SEQ ID NO: 1485 - protein, 12 aa, Artificial Sequence
  candidate mimic peptide
PFPGPGLAIRVI

SEQ ID NO: 1486 - protein, 13 aa, Artificial Sequence
  candidate mimic peptide
PFRLGLGGPIGSG

SEQ ID NO: 1487 - protein, 9 aa, Artificial Sequence
  candidate mimic peptide
PFSMGPLGS

SEQ ID NO: 1488 - protein, 10 aa, Artificial Sequence
  candidate mimic peptide
PFSMGPLGSP

SEQ ID NO: 1489 - protein, 9 aa, Artificial Sequence
  candidate mimic peptide
PGAGGTQRL

SEQ ID NO: 1490 - protein, 9 aa, Artificial Sequence
  candidate mimic peptide
PGAGKGTQA

SEQ ID NO: 1491 - protein, 11 aa, Artificial Sequence
  candidate mimic peptide
PGCDHAGIATQ

SEQ ID NO: 1492 - protein, 9 aa, Artificial Sequence
  candidate mimic peptide
PGDGIGPEI

SEQ ID NO: 1493 - protein, 9 aa, Artificial Sequence
  candidate mimic peptide
PGLAHFLEH

SEQ ID NO: 1494 - protein, 9 aa, Artificial Sequence
  candidate mimic peptide
PGLGKTTLA

SEQ ID NO: 1495 - protein, 10 aa, Artificial Sequence
  candidate mimic peptide
PGMVLTVEPG

SEQ ID NO: 1496 - protein, 10 aa, Artificial Sequence
  candidate mimic peptide
PGRVNLIGEH

SEQ ID NO: 1497 - protein, 14 aa, Artificial Sequence
  candidate mimic peptide
PGRVNLIGEHTDYN

SEQ ID NO: 1498 - protein, 9 aa, Artificial Sequence
  candidate mimic peptide
PGSGKGTQS

SEQ ID NO: 1499 - protein, 12 aa, Artificial Sequence
  candidate mimic peptide
PGSSIMPGKVNP

SEQ ID NO: 1500 - protein, 9 aa, Artificial Sequence
  candidate mimic peptide
PGTGKTLLA

SEQ ID NO: 1501 - protein, 11 aa, Artificial Sequence
  candidate mimic peptide
PGTGKTLLAKA

SEQ ID NO: 1502 - protein, 10 aa, Artificial Sequence
  candidate mimic peptide
PGVGQNLQDH

SEQ ID NO: 1503 - protein, 10 aa, Artificial Sequence
  candidate mimic peptide
PGYTHLQRAQ

SEQ ID NO: 1504 - protein, 12 aa, Artificial Sequence
  candidate mimic peptide
PGYTHLQRAQPI

SEQ ID NO: 1505 - protein, 9 aa, Artificial Sequence
  candidate mimic peptide
PHGLGHFLG

SEQ ID NO: 1506 - protein, 11 aa, Artificial Sequence
  candidate mimic peptide
PHLGASTKEAQ

SEQ ID NO: 1507 - protein, 14 aa, Artificial Sequence
  candidate mimic peptide
PHVNVGTIGHVDHG

SEQ ID NO: 1508 - protein, 9 aa, Artificial Sequence
  candidate mimic peptide
PIFHVNADD

SEQ ID NO: 1509 - protein, 9 aa, Artificial Sequence
  candidate mimic peptide
PIGRGQREL

SEQ ID NO: 1510 - protein, 19 aa, Artificial Sequence
  candidate mimic peptide
PIGRGQRELIIGDRQTGKT

SEQ ID NO: 1511 - protein, 29 aa, Artificial Sequence
  candidate mimic peptide
PIGRGQRELIIGDRQTGKTSIAIDTIINQ

SEQ ID NO: 1512 - protein, 10 aa, Artificial Sequence
  candidate mimic peptide
PIIMVGPGTG

SEQ ID NO: 1513 - protein, 19 aa, Artificial Sequence
  candidate mimic peptide
PILTMPNDDITHPIPDLTG

SEQ ID NO: 1514 - protein, 9 aa, Artificial Sequence
  candidate mimic peptide
PISAKLVAN

SEQ ID NO: 1515 - protein, 10 aa, Artificial Sequence
  candidate mimic peptide
PISAKLVANM

SEQ ID NO: 1516 - protein, 11 aa, Artificial Sequence
  candidate mimic peptide
PISAKLVANML

SEQ ID NO: 1517 - protein, 12 aa, Artificial Sequence
  candidate mimic peptide
PIVVEQTGRGER

SEQ ID NO: 1518 - protein, 9 aa, Artificial Sequence
  candidate mimic peptide
PIVYTPTVG

SEQ ID NO: 1519 - protein, 12 aa, Artificial Sequence
  candidate mimic peptide
PKDKPRYLMGVG

SEQ ID NO: 1520 - protein, 12 aa, Artificial Sequence
  candidate mimic peptide
PKGFGGVQVSPP

SEQ ID NO: 1521 - protein, 11 aa, Artificial Sequence
  candidate mimic peptide
PKGVLLYGPPG

SEQ ID NO: 1522 - protein, 9 aa, Artificial Sequence
  candidate mimic peptide
PKILLLDEP

SEQ ID NO: 1523 - protein, 17 aa, Artificial Sequence
  candidate mimic peptide
PLFILYTSGSTGKPKGV

SEQ ID NO: 1524 - protein, 14 aa, Artificial Sequence
  candidate mimic peptide
PLGVCVGIGAWNYP

SEQ ID NO: 1525 - protein, 9 aa, Artificial Sequence
  candidate mimic peptide
PLHVCEQRD

SEQ ID NO: 1526 - protein, 9 aa, Artificial Sequence
  candidate mimic peptide
PLIGFAGAP

SEQ ID NO: 1527 - protein, 9 aa, Artificial Sequence
  candidate mimic peptide
PLKGARIAG

SEQ ID NO: 1528 - protein, 9 aa, Artificial Sequence
  candidate mimic peptide
PLRGKILNV

SEQ ID NO: 1529 - protein, 9 aa, Artificial Sequence
  candidate mimic peptide
PLSVELGPG

SEQ ID NO: 1530 - protein, 10 aa, Artificial Sequence
  candidate mimic peptide
PLTGRTHQIR

SEQ ID NO: 1531 - protein, 11 aa, Artificial Sequence
  candidate mimic peptide
PLTLGGDHTIT

SEQ ID NO: 1532 - protein, 11 aa, Artificial Sequence
  candidate mimic peptide
PLVVRLEGTNV

SEQ ID NO: 1533 - protein, 12 aa, Artificial Sequence
  candidate mimic peptide
PMGWDAFGLPAE

SEQ ID NO: 1534 - protein, 15 aa, Artificial Sequence
  candidate mimic peptide
PMGWDAFGLPAENAA

SEQ ID NO: 1535 - protein, 9 aa, Artificial Sequence
  candidate mimic peptide
PNVGKSSFI

SEQ ID NO: 1536 - protein, 10 aa, Artificial Sequence
  candidate mimic peptide
PNVGKSSIIN

SEQ ID NO: 1537 - protein, 10 aa, Artificial Sequence
  candidate mimic peptide
PNVGKSSLIN

SEQ ID NO: 1538 - protein, 13 aa, Artificial Sequence
  candidate mimic peptide
PNVTDIVSIARAA

SEQ ID NO: 1539 - protein, 12 aa, Artificial Sequence
  candidate mimic peptide
PPKGVLLYGPPG

SEQ ID NO: 1540 - protein, 21 aa, Artificial Sequence
  candidate mimic peptide
PPKGVLLYGPPGCGKTLIAKA

SEQ ID NO: 1541 - protein, 10 aa, Artificial Sequence
  candidate mimic peptide
PPPNVTGSLH

SEQ ID NO: 1542 - protein, 12 aa, Artificial Sequence
  candidate mimic peptide
PQDATTNPSLIL

SEQ ID NO: 1543 - protein, 15 aa, Artificial Sequence
  candidate mimic peptide
PQGTLAERIRAGGAG

SEQ ID NO: 1544 - protein, 9 aa, Artificial Sequence
  candidate mimic peptide
PQILLLDEP

SEQ ID NO: 1545 - protein, 10 aa, Artificial Sequence
  candidate mimic peptide
PQNRVTDHRI

SEQ ID NO: 1546 - protein, 13 aa, Artificial Sequence
  candidate mimic peptide
PRFRGEHALRRYP

SEQ ID NO: 1547 - protein, 11 aa, Artificial Sequence
  candidate mimic peptide
PRNLAKSVTVE

SEQ ID NO: 1548 - protein, 11 aa, Artificial Sequence
  candidate mimic peptide
PSAFDRILASR

SEQ ID NO: 1549 - protein, 9 aa, Artificial Sequence
  candidate mimic peptide
PSGAGKSTL

SEQ ID NO: 1550 - protein, 13 aa, Artificial Sequence
  candidate mimic peptide
PTGGGKSLCYQLP

SEQ ID NO: 1551 - protein, 10 aa, Artificial Sequence
  candidate mimic peptide
PTQGMRQGND

SEQ ID NO: 1552 - protein, 9 aa, Artificial Sequence
  candidate mimic peptide
PVDIYIPGC

SEQ ID NO: 1553 - protein, 10 aa, Artificial Sequence
  candidate mimic peptide
PVDLFPHTPH

SEQ ID NO: 1554 - protein, 15 aa, Artificial Sequence
  candidate mimic peptide
PVFGICLGHQLLALA

SEQ ID NO: 1555 - protein, 9 aa, Artificial Sequence
  candidate mimic peptide
PVFNTVKEA

SEQ ID NO: 1556 - protein, 9 aa, Artificial Sequence
  candidate mimic peptide
PVLGICYGM

SEQ ID NO: 1557 - protein, 10 aa, Artificial Sequence
  candidate mimic peptide
PVLGICYGMQ

SEQ ID NO: 1558 - protein, 11 aa, Artificial Sequence
  candidate mimic peptide
PVTLELGGKSP

SEQ ID NO: 1559 - protein, 9 aa, Artificial Sequence
  candidate mimic peptide
PVVAMVWEG

SEQ ID NO: 1560 - protein, 14 aa, Artificial Sequence
  candidate mimic peptide
PVVTIMGHVDHGKT

SEQ ID NO: 1561 - protein, 18 aa, Artificial Sequence
  candidate mimic peptide
PVVTIMGHVDHGKTTLLD

SEQ ID NO: 1562 - protein, 19 aa, Artificial Sequence
  candidate mimic peptide
PVVTIMGHVDHGKTTLLDK

SEQ ID NO: 1563 - protein, 14 aa, Artificial Sequence
  candidate mimic peptide
PWGKGRPGWHIECS

SEQ ID NO: 1564 - protein, 16 aa, Artificial Sequence
  candidate mimic peptide
PWGKGRPGWHIECSAM

SEQ ID NO: 1565 - protein, 17 aa, Artificial Sequence
  candidate mimic peptide
PWGKGRPGWHIECSAMA

SEQ ID NO: 1566 - protein, 9 aa, Artificial Sequence
  candidate mimic peptide
PWTIPANEA

SEQ ID NO: 1567 - protein, 12 aa, Artificial Sequence
  candidate mimic peptide
PWTIRQYAGFST

SEQ ID NO: 1568 - protein, 10 aa, Artificial Sequence
  candidate mimic peptide
PWVRNIFIVT

SEQ ID NO: 1569 - protein, 13 aa, Artificial Sequence
  candidate mimic peptide
PYPSGKLHMGHVR

SEQ ID NO: 1570 - protein, 11 aa, Artificial Sequence
  candidate mimic peptide
PYVSGFLAFRE

SEQ ID NO: 1571 - protein, 9 aa, Artificial Sequence
  candidate mimic peptide
QAHGLCFSV

SEQ ID NO: 1572 - protein, 10 aa, Artificial Sequence
  candidate mimic peptide
QAHGLCFSVQ

SEQ ID NO: 1573 - protein, 9 aa, Artificial Sequence
  candidate mimic peptide
QCGTIQLDF

SEQ ID NO: 1574 - protein, 9 aa, Artificial Sequence
  candidate mimic peptide
QDDAHIFCT

SEQ ID NO: 1575 - protein, 11 aa, Artificial Sequence
  candidate mimic peptide
QDFTGVPAVVD

SEQ ID NO: 1576 - protein, 10 aa, Artificial Sequence
  candidate mimic peptide
QDPLAELVKI

SEQ ID NO: 1577 - protein, 13 aa, Artificial Sequence
  candidate mimic peptide
QDPLAELVKIEPK

SEQ ID NO: 1578 - protein, 9 aa, Artificial Sequence
  candidate mimic peptide
QEEIFGPVL

SEQ ID NO: 1579 - protein, 10 aa, Artificial Sequence
  candidate mimic peptide
QGARLTAFEL

SEQ ID NO: 1580 - protein, 11 aa, Artificial Sequence
  candidate mimic peptide
QGFFDIPVDNL

SEQ ID NO: 1581 - protein, 12 aa, Artificial Sequence
  candidate mimic peptide
QGMNAAVRAVVR

SEQ ID NO: 1582 - protein, 9 aa, Artificial Sequence
  candidate mimic peptide
QGMRQGNDH

SEQ ID NO: 1583 - protein, 19 aa, Artificial Sequence
  candidate mimic peptide
QGMRQGNDHGTQYRSAIYP

SEQ ID NO: 1584 - protein, 15 aa, Artificial Sequence
  candidate mimic peptide
QGNDHGTQYRSAIYP

SEQ ID NO: 1585 - protein, 12 aa, Artificial Sequence
  candidate mimic peptide
QGVLLLNAVLTV

SEQ ID NO: 1586 - protein, 13 aa, Artificial Sequence
  candidate mimic peptide
QGVLLLNAVLTVR

SEQ ID NO: 1587 - protein, 14 aa, Artificial Sequence
  candidate mimic peptide
QGVLLLNAVLTVRA

SEQ ID NO: 1588 - protein, 13 aa, Artificial Sequence
  candidate mimic peptide
QHLFWFFGHPEVY

SEQ ID NO: 1589 - protein, 14 aa, Artificial Sequence
  candidate mimic peptide
QHLFWFFGHPEVYI

SEQ ID NO: 1590 - protein, 9 aa, Artificial Sequence
  candidate mimic peptide
QILTEPRNA

SEQ ID NO: 1591 - protein, 9 aa, Artificial Sequence
  candidate mimic peptide
QIQGFFDIP

SEQ ID NO: 1592 - protein, 11 aa, Artificial Sequence
  candidate mimic peptide
QIQGFFDIPVD

SEQ ID NO: 1593 - protein, 12 aa, Artificial Sequence
  candidate mimic peptide
QIQGFFDIPVDN

SEQ ID NO: 1594 - protein, 14 aa, Artificial Sequence
  candidate mimic peptide
QIQGFFDIPVDNLY

SEQ ID NO: 1595 - protein, 10 aa, Artificial Sequence
  candidate mimic peptide
QIQNALGSDI

SEQ ID NO: 1596 - protein, 12 aa, Artificial Sequence
  candidate mimic peptide
QIYRIDHYLGKE

SEQ ID NO: 1597 - protein, 10 aa, Artificial Sequence
  candidate mimic peptide
QKEVAERLAA

SEQ ID NO: 1598 - protein, 11 aa, Artificial Sequence
  candidate mimic peptide
QKEVAERLAAN

SEQ ID NO: 1599 - protein, 9 aa, Artificial Sequence
  candidate mimic peptide
QKGTGRARH

SEQ ID NO: 1600 - protein, 10 aa, Artificial Sequence
  candidate mimic peptide
QLDTPERGFS

SEQ ID NO: 1601 - protein, 12 aa, Artificial Sequence
  candidate mimic peptide
QLKGAGPTPFSR

SEQ ID NO: 1602 - protein, 14 aa, Artificial Sequence
  candidate mimic peptide
QLKQFTTVVADTGD

SEQ ID NO: 1603 - protein, 15 aa, Artificial Sequence
  candidate mimic peptide
QLKQFTTVVADTGDF

SEQ ID NO: 1604 - protein, 9 aa, Artificial Sequence
  candidate mimic peptide
QLSGGQKQR

SEQ ID NO: 1605 - protein, 10 aa, Artificial Sequence
  candidate mimic peptide
QLSGGQKQRV

SEQ ID NO: 1606 - protein, 11 aa, Artificial Sequence
  candidate mimic peptide
QLSGGQKQRVA

SEQ ID NO: 1607 - protein, 9 aa, Artificial Sequence
  candidate mimic peptide
QLYQRSGDM

SEQ ID NO: 1608 - protein, 9 aa, Artificial Sequence
  candidate mimic peptide
QMQYNLRLR

SEQ ID NO: 1609 - protein, 22 aa, Artificial Sequence
  candidate mimic peptide
QPPKGVLLYGPPGCGKTLIAKA

SEQ ID NO: 1610 - protein, 10 aa, Artificial Sequence
  candidate mimic peptide
QREDDKPETV

SEQ ID NO: 1611 - protein, 9 aa, Artificial Sequence
  candidate mimic peptide
QRIAIARAL

SEQ ID NO: 1612 - protein, 10 aa, Artificial Sequence
  candidate mimic peptide
QRIAIARALV

SEQ ID NO: 1613 - protein, 9 aa, Artificial Sequence
  candidate mimic peptide
QRLAIARAL

SEQ ID NO: 1614 - protein, 9 aa, Artificial Sequence
  candidate mimic peptide
QRQATKDAG

SEQ ID NO: 1615 - protein, 11 aa, Artificial Sequence
  candidate mimic peptide
QRRQALRQLDG

SEQ ID NO: 1616 - protein, 9 aa, Artificial Sequence
  candidate mimic peptide
QRVAIARAI

SEQ ID NO: 1617 - protein, 10 aa, Artificial Sequence
  candidate mimic peptide
QRVTRASVTV

SEQ ID NO: 1618 - protein, 9 aa, Artificial Sequence
  candidate mimic peptide
QSLAIIEYL

SEQ ID NO: 1619 - protein, 9 aa, Artificial Sequence
  candidate mimic peptide
QSPDIAQGV

SEQ ID NO: 1620 - protein, 10 aa, Artificial Sequence
  candidate mimic peptide
QSSNDTFPTA

SEQ ID NO: 1621 - protein, 10 aa, Artificial Sequence
  candidate mimic peptide
QTLLFSATMP

SEQ ID NO: 1622 - protein, 9 aa, Artificial Sequence
  candidate mimic peptide
QTREQHIRR

SEQ ID NO: 1623 - protein, 9 aa, Artificial Sequence
  candidate mimic peptide
QVDTTNILF

SEQ ID NO: 1624 - protein, 12 aa, Artificial Sequence
  candidate mimic peptide
QVEHPVTEMITG

SEQ ID NO: 1625 - protein, 12 aa, Artificial Sequence
  candidate mimic peptide
QVVAPSDMMDGR

SEQ ID NO: 1626 - protein, 9 aa, Artificial Sequence
  candidate mimic peptide
QWGDEGKGK

SEQ ID NO: 1627 - protein, 10 aa, Artificial Sequence
  candidate mimic peptide
QWGDEGKGKV

SEQ ID NO: 1628 - protein, 12 aa, Artificial Sequence
  candidate mimic peptide
QWGDEGKGKVVD

SEQ ID NO: 1629 - protein, 14 aa, Artificial Sequence
  candidate mimic peptide
QWGDEGKGKVVDLL

SEQ ID NO: 1630 - protein, 10 aa, Artificial Sequence
  candidate mimic peptide
QYHPEFLSRP

SEQ ID NO: 1631 - protein, 9 aa, Artificial Sequence
  candidate mimic peptide
QYLAAAGVG

SEQ ID NO: 1632 - protein, 11 aa, Artificial Sequence
  candidate mimic peptide
RAAVPSGASTG

SEQ ID NO: 1633 - protein, 12 aa, Artificial Sequence
  candidate mimic peptide
RAAVPSGASTGI

SEQ ID NO: 1634 - protein, 15 aa, Artificial Sequence
  candidate mimic peptide
RAAVPSGASTGIYEA

SEQ ID NO: 1635 - protein, 9 aa, Artificial Sequence
  candidate mimic peptide
RAGGKHNDL

SEQ ID NO: 1636 - protein, 10 aa, Artificial Sequence
  candidate mimic peptide
RAGGKHNDLD

SEQ ID NO: 1637 - protein, 11 aa, Artificial Sequence
  candidate mimic peptide
RALFGTIDSWL

SEQ ID NO: 1638 - protein, 9 aa, Artificial Sequence
  candidate mimic peptide
RASGAGGQH

SEQ ID NO: 1639 - protein, 11 aa, Artificial Sequence
  candidate mimic peptide
RASGAGGQHVN

SEQ ID NO: 1640 - protein, 9 aa, Artificial Sequence
  candidate mimic peptide
RAVLHVALR

SEQ ID NO: 1641 - protein, 11 aa, Artificial Sequence
  candidate mimic peptide
RAVLHVALRNR

SEQ ID NO: 1642 - protein, 16 aa, Artificial Sequence
  candidate mimic peptide
RAVLHVALRNRSNTPI

SEQ ID NO: 1643 - protein, 28 aa, Artificial Sequence
  candidate mimic peptide
RAVLHVALRNRSNTPILVDGKDVMPEVN

SEQ ID NO: 1644 - protein, 11 aa, Artificial Sequence
  candidate mimic peptide
RDCSIQRRHQK

SEQ ID NO: 1645 - protein, 11 aa, Artificial Sequence
  candidate mimic peptide
RDCSVQRRHQK

SEQ ID NO: 1646 - protein, 10 aa, Artificial Sequence
  candidate mimic peptide
RDGFVMGEGA

SEQ ID NO: 1647 - protein, 17 aa, Artificial Sequence
  candidate mimic peptide
RDGFVMGEGAAVLVLEE

SEQ ID NO: 1648 - protein, 10 aa, Artificial Sequence
  candidate mimic peptide
RDGKLYGRGS

SEQ ID NO: 1649 - protein, 9 aa, Artificial Sequence
  candidate mimic peptide
RDHRKIGKE

SEQ ID NO: 1650 - protein, 9 aa, Artificial Sequence
  candidate mimic peptide
RDMKPENVL

SEQ ID NO: 1651 - protein, 13 aa, Artificial Sequence
  candidate mimic peptide
RDPRGFAVKFYTE

SEQ ID NO: 1652 - protein, 10 aa, Artificial Sequence
  candidate mimic peptide
REGNDLYHEM

SEQ ID NO: 1653 - protein, 15 aa, Artificial Sequence
  candidate mimic peptide
REILDSRGNPTVEVD

SEQ ID NO: 1654 - protein, 22 aa, Artificial Sequence
  candidate mimic peptide
REKLDGLYECILCACCSTSCPS

SEQ ID NO: 1655 - protein, 10 aa, Artificial Sequence
  candidate mimic peptide
RELLAVPDNY

SEQ ID NO: 1656 - protein, 15 aa, Artificial Sequence
  candidate mimic peptide
REQHIRRDKATSNIC

SEQ ID NO: 1657 - protein, 11 aa, Artificial Sequence
  candidate mimic peptide
RERIPERVVHA

SEQ ID NO: 1658 - protein, 13 aa, Artificial Sequence
  candidate mimic peptide
RERIPERVVHAKG

SEQ ID NO: 1659 - protein, 16 aa, Artificial Sequence
  candidate mimic peptide
RERIPERVVHAKGAGA

SEQ ID NO: 1660 - protein, 10 aa, Artificial Sequence
  candidate mimic peptide
RETDTMDTFV

SEQ ID NO: 1661 - protein, 12 aa, Artificial Sequence
  candidate mimic peptide
RETDTMDTFVDS

SEQ ID NO: 1662 - protein, 9 aa, Artificial Sequence
  candidate mimic peptide
REVDALDGL

SEQ ID NO: 1663 - protein, 11 aa, Artificial Sequence
  candidate mimic peptide
RFAPSPTGFLH

SEQ ID NO: 1664 - protein, 9 aa, Artificial Sequence
  candidate mimic peptide
RGANLSGGQ

SEQ ID NO: 1665 - protein, 13 aa, Artificial Sequence
  candidate mimic peptide
RGERAYDIYSRLL

SEQ ID NO: 1666 - protein, 9 aa, Artificial Sequence
  candidate mimic peptide
RGFAVKFYT

SEQ ID NO: 1667 - protein, 10 aa, Artificial Sequence
  candidate mimic peptide
RGITIQSAAT

SEQ ID NO: 1668 - protein, 10 aa, Artificial Sequence
  candidate mimic peptide
RGKGLMIGIE

SEQ ID NO: 1669 - protein, 10 aa, Artificial Sequence
  candidate mimic peptide
RGLDYYTGVI

SEQ ID NO: 1670 - protein, 9 aa, Artificial Sequence
  candidate mimic peptide
RGRSINLAL

SEQ ID NO: 1671 - protein, 10 aa, Artificial Sequence
  candidate mimic peptide
RGSGGFGSTG

SEQ ID NO: 1672 - protein, 9 aa, Artificial Sequence
  candidate mimic peptide
RHPFPGPGL

SEQ ID NO: 1673 - protein, 10 aa, Artificial Sequence
  candidate mimic peptide
RHPFPGPGLA

SEQ ID NO: 1674 - protein, 12 aa, Artificial Sequence
  candidate mimic peptide
RHPFPGPGLAIR

SEQ ID NO: 1675 - protein, 14 aa, Artificial Sequence
  candidate mimic peptide
RHPFPGPGLAIRVI

SEQ ID NO: 1676 - protein, 9 aa, Artificial Sequence
  candidate mimic peptide
RIDHYLGKE

SEQ ID NO: 1677 - protein, 10 aa, Artificial Sequence
  candidate mimic peptide
RIDHYLGKEM

SEQ ID NO: 1678 - protein, 13 aa, Artificial Sequence
  candidate mimic peptide
RIDHYLGKEMVQN

SEQ ID NO: 1679 - protein, 9 aa, Artificial Sequence
  candidate mimic peptide
RIINEPTAA

SEQ ID NO: 1680 - protein, 10 aa, Artificial Sequence
  candidate mimic peptide
RIINEPTAAA

SEQ ID NO: 1681 - protein, 9 aa, Artificial Sequence
  candidate mimic peptide
RIIVEKPFG

SEQ ID NO: 1682 - protein, 9 aa, Artificial Sequence
  candidate mimic peptide
RILLDAPCS

SEQ ID NO: 1683 - protein, 9 aa, Artificial Sequence
  candidate mimic peptide
RIRFTSPHP

SEQ ID NO: 1684 - protein, 9 aa, Artificial Sequence
  candidate mimic peptide
RKICAIGVR

SEQ ID NO: 1685 - protein, 10 aa, Artificial Sequence
  candidate mimic peptide
RKLALKYHPD

SEQ ID NO: 1686 - protein, 9 aa, Artificial Sequence
  candidate mimic peptide
RLAIARALL

SEQ ID NO: 1687 - protein, 10 aa, Artificial Sequence
  candidate mimic peptide
RLDILVNNAG

SEQ ID NO: 1688 - protein, 10 aa, Artificial Sequence
  candidate mimic peptide
RLEFLGDAIL

SEQ ID NO: 1689 - protein, 11 aa, Artificial Sequence
  candidate mimic peptide
RLEFLGDAILD

SEQ ID NO: 1690 - protein, 11 aa, Artificial Sequence
  candidate mimic peptide
RLEYRGYDSAG

SEQ ID NO: 1691 - protein, 12 aa, Artificial Sequence
  candidate mimic peptide
RLEYRGYDSAGV

SEQ ID NO: 1692 - protein, 10 aa, Artificial Sequence
  candidate mimic peptide
RLGFEGGQTP

SEQ ID NO: 1693 - protein, 9 aa, Artificial Sequence
  candidate mimic peptide
RLKTGTPPR

SEQ ID NO: 1694 - protein, 10 aa, Artificial Sequence
  candidate mimic peptide
RLKTGTPPRI

SEQ ID NO: 1695 - protein, 9 aa, Artificial Sequence
  candidate mimic peptide
RLLYVSCNP

SEQ ID NO: 1696 - protein, 12 aa, Artificial Sequence
  candidate mimic peptide
RLVLEVAQHLGE

SEQ ID NO: 1697 - protein, 10 aa, Artificial Sequence
  candidate mimic peptide
RMTGGGFGGC

SEQ ID NO: 1698 - protein, 16 aa, Artificial Sequence
  candidate mimic peptide
RNIGIMAHIDAGKTTT

SEQ ID NO: 1699 - protein, 19 aa, Artificial Sequence
  candidate mimic peptide
RNIGIMAHIDAGKTTTTER

SEQ ID NO: 1700 - protein, 21 aa, Artificial Sequence
  candidate mimic peptide
RNIGIMAHIDAGKTTTTERIL

SEQ ID NO: 1701 - protein, 23 aa, Artificial Sequence
  candidate mimic peptide
RNIGIMAHIDAGKTTTTERILYY

SEQ ID NO: 1702 - protein, 10 aa, Artificial Sequence
  candidate mimic peptide
RNIGISAHID

SEQ ID NO: 1703 - protein, 12 aa, Artificial Sequence
  candidate mimic peptide
RPRFGLLRGREF

SEQ ID NO: 1704 - protein, 10 aa, Artificial Sequence
  candidate mimic peptide
RPRGGDFLYS

SEQ ID NO: 1705 - protein, 13 aa, Artificial Sequence
  candidate mimic peptide
RPWTIRQYAGFST

SEQ ID NO: 1706 - protein, 9 aa, Artificial Sequence
  candidate mimic peptide
RQPEFTQID

SEQ ID NO: 1707 - protein, 9 aa, Artificial Sequence
  candidate mimic peptide
RQTLLFSAT

SEQ ID NO: 1708 - protein, 11 aa, Artificial Sequence
  candidate mimic peptide
RQTLLFSATMP

SEQ ID NO: 1709 - protein, 10 aa, Artificial Sequence
  candidate mimic peptide
RRGRYVEFNL

SEQ ID NO: 1710 - protein, 16 aa, Artificial Sequence
  candidate mimic peptide
RRGRYVEFNLLYDRGT

SEQ ID NO: 1711 - protein, 10 aa, Artificial Sequence
  candidate mimic peptide
RRLLYVSCNP

SEQ ID NO: 1712 - protein, 10 aa, Artificial Sequence
  candidate mimic peptide
RRLQVQERLT

SEQ ID NO: 1713 - protein, 10 aa, Artificial Sequence
  candidate mimic peptide
RRVLRPGGVL

SEQ ID NO: 1714 - protein, 9 aa, Artificial Sequence
  candidate mimic peptide
RRVVITGIG

SEQ ID NO: 1715 - protein, 9 aa, Artificial Sequence
  candidate mimic peptide
RSAVSIARR

SEQ ID NO: 1716 - protein, 9 aa, Artificial Sequence
  candidate mimic peptide
RSPLWRGGG

SEQ ID NO: 1717 - protein, 9 aa, Artificial Sequence
  candidate mimic peptide
RTDAGVHAL

SEQ ID NO: 1718 - protein, 9 aa, Artificial Sequence
  candidate mimic peptide
RTNTCGELR

SEQ ID NO: 1719 - protein, 10 aa, Artificial Sequence
  candidate mimic peptide
RTSHYPYAEE

SEQ ID NO: 1720 - protein, 9 aa, Artificial Sequence
  candidate mimic peptide
RTTLLPGLL

SEQ ID NO: 1721 - protein, 10 aa, Artificial Sequence
  candidate mimic peptide
RVALIGDAAH

SEQ ID NO: 1722 - protein, 9 aa, Artificial Sequence
  candidate mimic peptide
RVDFNVPMK

SEQ ID NO: 1723 - protein, 9 aa, Artificial Sequence
  candidate mimic peptide
RVEAFSDGV

SEQ ID NO: 1724 - protein, 9 aa, Artificial Sequence
  candidate mimic peptide
RVEEMRQSL

SEQ ID NO: 1725 - protein, 9 aa, Artificial Sequence
  candidate mimic peptide
RVGIGRPAH

SEQ ID NO: 1726 - protein, 11 aa, Artificial Sequence
  candidate mimic peptide
RVILQDFTGVP

SEQ ID NO: 1727 - protein, 15 aa, Artificial Sequence
  candidate mimic peptide
RVILQDFTGVPAVVD

SEQ ID NO: 1728 - protein, 9 aa, Artificial Sequence
  candidate mimic peptide
RVLRLPAVA

SEQ ID NO: 1729 - protein, 10 aa, Artificial Sequence
  candidate mimic peptide
RVRFAPSPTG

SEQ ID NO: 1730 - protein, 10 aa, Artificial Sequence
  candidate mimic peptide
RVRIALALKG

SEQ ID NO: 1731 - protein, 12 aa, Artificial Sequence
  candidate mimic peptide
RVTVLGHVQRGG

SEQ ID NO: 1732 - protein, 9 aa, Artificial Sequence
  candidate mimic peptide
RVVDASIMP

SEQ ID NO: 1733 - protein, 9 aa, Artificial Sequence
  candidate mimic peptide
RYCINSAAL

SEQ ID NO: 1734 - protein, 11 aa, Artificial Sequence
  candidate mimic peptide
RYLGDLSGGQV

SEQ ID NO: 1735 - protein, 10 aa, Artificial Sequence
  candidate mimic peptide
RYRQRYLDLI

SEQ ID NO: 1736 - protein, 10 aa, Artificial Sequence
  candidate mimic peptide
SAHGTNPASA

SEQ ID NO: 1737 - protein, 10 aa, Artificial Sequence
  candidate mimic peptide
SCNIFSTQDH

SEQ ID NO: 1738 - protein, 14 aa, Artificial Sequence
  candidate mimic peptide
SCTTNCLAPLAKVI

SEQ ID NO: 1739 - protein, 9 aa, Artificial Sequence
  candidate mimic peptide
SDAFFPFRD

SEQ ID NO: 1740 - protein, 9 aa, Artificial Sequence
  candidate mimic peptide
SDAYSTGSS

SEQ ID NO: 1741 - protein, 15 aa, Artificial Sequence
  candidate mimic peptide
SDELNHASIIDGIRL

SEQ ID NO: 1742 - protein, 9 aa, Artificial Sequence
  candidate mimic peptide
SDELNHASL

SEQ ID NO: 1743 - protein, 12 aa, Artificial Sequence
  candidate mimic peptide
SDGIMVARGDLG

SEQ ID NO: 1744 - protein, 9 aa, Artificial Sequence
  candidate mimic peptide
SDHIETLYE

SEQ ID NO: 1745 - protein, 12 aa, Artificial Sequence
  candidate mimic peptide
SDVANAVLDGAD

SEQ ID NO: 1746 - protein, 9 aa, Artificial Sequence
  candidate mimic peptide
SEDMLGRVF

SEQ ID NO: 1747 - protein, 9 aa, Artificial Sequence
  candidate mimic peptide
SEKETGDRN

SEQ ID NO: 1748 - protein, 9 aa, Artificial Sequence
  candidate mimic peptide
SERIRTYNF

SEQ ID NO: 1749 - protein, 14 aa, Artificial Sequence
  candidate mimic peptide
SEVMLQQTQVATVI

SEQ ID NO: 1750 - protein, 9 aa, Artificial Sequence
  candidate mimic peptide
SFHSLEDRI

SEQ ID NO: 1751 - protein, 11 aa, Artificial Sequence
  candidate mimic peptide
SFHSLEDRIVK

SEQ ID NO: 1752 - protein, 14 aa, Artificial Sequence
  candidate mimic peptide
SFITPVPGGVGPMT

SEQ ID NO: 1753 - protein, 9 aa, Artificial Sequence
  candidate mimic peptide
SFTGSTQVG

SEQ ID NO: 1754 - protein, 11 aa, Artificial Sequence
  candidate mimic peptide
SFTKGCYIGQE

SEQ ID NO: 1755 - protein, 9 aa, Artificial Sequence
  candidate mimic peptide
SGAGGQHVN

SEQ ID NO: 1756 - protein, 14 aa, Artificial Sequence
  candidate mimic peptide
SGAGGQHVNTTDSA

SEQ ID NO: 1757 - protein, 17 aa, Artificial Sequence
  candidate mimic peptide
SGAGGQHVNTTDSAVRI

SEQ ID NO: 1758 - protein, 9 aa, Artificial Sequence
  candidate mimic peptide
SGAGKSSLI

SEQ ID NO: 1759 - protein, 9 aa, Artificial Sequence
  candidate mimic peptide
SGAGKSSLL

SEQ ID NO: 1760 - protein, 10 aa, Artificial Sequence
  candidate mimic peptide
SGAGKSTLLN

SEQ ID NO: 1761 - protein, 9 aa, Artificial Sequence
  candidate mimic peptide
SGAGKSTLM

SEQ ID NO: 1762 - protein, 9 aa, Artificial Sequence
  candidate mimic peptide
SGAHLNPAV

SEQ ID NO: 1763 - protein, 10 aa, Artificial Sequence
  candidate mimic peptide
SGAHLNPAVT

SEQ ID NO: 1764 - protein, 9 aa, Artificial Sequence
  candidate mimic peptide
SGDLAPLSH

SEQ ID NO: 1765 - protein, 9 aa, Artificial Sequence
  candidate mimic peptide
SGEPMDKAG

SEQ ID NO: 1766 - protein, 10 aa, Artificial Sequence
  candidate mimic peptide
SGFPKNRVIG

SEQ ID NO: 1767 - protein, 11 aa, Artificial Sequence
  candidate mimic peptide
SGGGSGHEPAH

SEQ ID NO: 1768 - protein, 9 aa, Artificial Sequence
  candidate mimic peptide
SGGPNSVYA

SEQ ID NO: 1769 - protein, 12 aa, Artificial Sequence
  candidate mimic peptide
SGGPNSVYAEDA

SEQ ID NO: 1770 - protein, 9 aa, Artificial Sequence
  candidate mimic peptide
SGGQKQRIA

SEQ ID NO: 1771 - protein, 12 aa, Artificial Sequence
  candidate mimic peptide
SGGQKQRISLAR

SEQ ID NO: 1772 - protein, 10 aa, Artificial Sequence
  candidate mimic peptide
SGHKIYGPKG

SEQ ID NO: 1773 - protein, 12 aa, Artificial Sequence
  candidate mimic peptide
SGHWEHYQEDMF

SEQ ID NO: 1774 - protein, 9 aa, Artificial Sequence
  candidate mimic peptide
SGIGRAVSV

SEQ ID NO: 1775 - protein, 10 aa, Artificial Sequence
  candidate mimic peptide
SGILVQLPLP

SEQ ID NO: 1776 - protein, 9 aa, Artificial Sequence
  candidate mimic peptide
SGKGGVGKS

SEQ ID NO: 1777 - protein, 10 aa, Artificial Sequence
  candidate mimic peptide
SGKGGVGKST

SEQ ID NO: 1778 - protein, 14 aa, Artificial Sequence
  candidate mimic peptide
SGLRGRGGAGFPTG

SEQ ID NO: 1779 - protein, 20 aa, Artificial Sequence
  candidate mimic peptide
SGLRGRGGAGFPTGLKWSFM

SEQ ID NO: 1780 - protein, 9 aa, Artificial Sequence
  candidate mimic peptide
SGLRLGTPA

SEQ ID NO: 1781 - protein, 11 aa, Artificial Sequence
  candidate mimic peptide
SGLRLGTPALT

SEQ ID NO: 1782 - protein, 9 aa, Artificial Sequence
  candidate mimic peptide
SGPLVRSSY

SEQ ID NO: 1783 - protein, 10 aa, Artificial Sequence
  candidate mimic peptide
SGPSGAGKST

SEQ ID NO: 1784 - protein, 13 aa, Artificial Sequence
  candidate mimic peptide
SGPSGAGKSTLLK

SEQ ID NO: 1785 - protein, 9 aa, Artificial Sequence
  candidate mimic peptide
SGSGKTTLL

SEQ ID NO: 1786 - protein, 9 aa, Artificial Sequence
  candidate mimic peptide
SGTDGVGTK

SEQ ID NO: 1787 - protein, 10 aa, Artificial Sequence
  candidate mimic peptide
SGTDGVGTKL

SEQ ID NO: 1788 - protein, 11 aa, Artificial Sequence
  candidate mimic peptide
SGTDGVGTKLK

SEQ ID NO: 1789 - protein, 13 aa, Artificial Sequence
  candidate mimic peptide
SGTDGVGTKLKIA

SEQ ID NO: 1790 - protein, 9 aa, Artificial Sequence
  candidate mimic peptide
SGVGKSSLV

SEQ ID NO: 1791 - protein, 9 aa, Artificial Sequence
  candidate mimic peptide
SGWDFSSRW

SEQ ID NO: 1792 - protein, 10 aa, Artificial Sequence
  candidate mimic peptide
SIPVIANGDI

SEQ ID NO: 1793 - protein, 10 aa, Artificial Sequence
  candidate mimic peptide
SIRDVIAFPK

SEQ ID NO: 1794 - protein, 10 aa, Artificial Sequence
  candidate mimic peptide
SIVVAPSQTL

SEQ ID NO: 1795 - protein, 9 aa, Artificial Sequence
  candidate mimic peptide
SKAGVIGLT

SEQ ID NO: 1796 - protein, 9 aa, Artificial Sequence
  candidate mimic peptide
SKKARDGKL

SEQ ID NO: 1797 - protein, 9 aa, Artificial Sequence
  candidate mimic peptide
SKPGEPSWP

SEQ ID NO: 1798 - protein, 9 aa, Artificial Sequence
  candidate mimic peptide
SKPLKGARI

SEQ ID NO: 1799 - protein, 9 aa, Artificial Sequence
  candidate mimic peptide
SLKKLQLDY

SEQ ID NO: 1800 - protein, 10 aa, Artificial Sequence
  candidate mimic peptide
SLLGGGGVDG

SEQ ID NO: 1801 - protein, 9 aa, Artificial Sequence
  candidate mimic peptide
SLNVSVAAG

SEQ ID NO: 1802 - protein, 12 aa, Artificial Sequence
  candidate mimic peptide
SLPNSRIMIHQP

SEQ ID NO: 1803 - protein, 13 aa, Artificial Sequence
  candidate mimic peptide
SLWPMTFGLACCA

SEQ ID NO: 1804 - protein, 18 aa, Artificial Sequence
  candidate mimic peptide
SLWPMTFGLACCAVEMMH

SEQ ID NO: 1805 - protein, 10 aa, Artificial Sequence
  candidate mimic peptide
SMCEHHLVPF

SEQ ID NO: 1806 - protein, 9 aa, Artificial Sequence
  candidate mimic peptide
SMRIMTRMG

SEQ ID NO: 1807 - protein, 9 aa, Artificial Sequence
  candidate mimic peptide
SNASCTTNC

SEQ ID NO: 1808 - protein, 9 aa, Artificial Sequence
  candidate mimic peptide
SNASDALDK

SEQ ID NO: 1809 - protein, 9 aa, Artificial Sequence
  candidate mimic peptide
SNHGGRQLD

SEQ ID NO: 1810 - protein, 9 aa, Artificial Sequence
  candidate mimic peptide
SNPVDILTY

SEQ ID NO: 1811 - protein, 9 aa, Artificial Sequence
  candidate mimic peptide
SPAEKAGLQ

SEQ ID NO: 1812 - protein, 9 aa, Artificial Sequence
  candidate mimic peptide
SPCGACRQV

SEQ ID NO: 1813 - protein, 10 aa, Artificial Sequence
  candidate mimic peptide
SPDKDVDGFH

SEQ ID NO: 1814 - protein, 9 aa, Artificial Sequence
  candidate mimic peptide
SPNGKLRLL

SEQ ID NO: 1815 - protein, 14 aa, Artificial Sequence
  candidate mimic peptide
SPRFRGEHALRRYP

SEQ ID NO: 1816 - protein, 9 aa, Artificial Sequence
  candidate mimic peptide
SPRQSDVMI

SEQ ID NO: 1817 - protein, 10 aa, Artificial Sequence
  candidate mimic peptide
SQGRLESLLN

SEQ ID NO: 1818 - protein, 10 aa, Artificial Sequence
  candidate mimic peptide
SQSGETADTL

SEQ ID NO: 1819 - protein, 12 aa, Artificial Sequence
  candidate mimic peptide
SQSSNDTFPTAM

SEQ ID NO: 1820 - protein, 9 aa, Artificial Sequence
  candidate mimic peptide
SQWGHDFRP

SEQ ID NO: 1821 - protein, 13 aa, Artificial Sequence
  candidate mimic peptide
SRHPFPGPGLAIR

SEQ ID NO: 1822 - protein, 12 aa, Artificial Sequence
  candidate mimic peptide
SRQRYWGTPIPI

SEQ ID NO: 1823 - protein, 10 aa, Artificial Sequence
  candidate mimic peptide
SRTDAGVHAL

SEQ ID NO: 1824 - protein, 9 aa, Artificial Sequence
  candidate mimic peptide
SRTRVKTLA

SEQ ID NO: 1825 - protein, 9 aa, Artificial Sequence
  candidate mimic peptide
SRVALVTGA

SEQ ID NO: 1826 - protein, 9 aa, Artificial Sequence
  candidate mimic peptide
SSGSACTSA

SEQ ID NO: 1827 - protein, 19 aa, Artificial Sequence
  candidate mimic peptide
SSGSACTSASLEPSYVLRA

SEQ ID NO: 1828 - protein, 21 aa, Artificial Sequence
  candidate mimic peptide
SSGSACTSASLEPSYVLRAIG

SEQ ID NO: 1829 - protein, 9 aa, Artificial Sequence
  candidate mimic peptide
SSPNTAGLR

SEQ ID NO: 1830 - protein, 10 aa, Artificial Sequence
  candidate mimic peptide
SSRTDAGVHA

SEQ ID NO: 1831 - protein, 11 aa, Artificial Sequence
  candidate mimic peptide
SSRTDAGVHAL

SEQ ID NO: 1832 - protein, 9 aa, Artificial Sequence
  candidate mimic peptide
STGGGASLE

SEQ ID NO: 1833 - protein, 10 aa, Artificial Sequence
  candidate mimic peptide
STGGGASLEL

SEQ ID NO: 1834 - protein, 14 aa, Artificial Sequence
  candidate mimic peptide
STGGGASLELLEGK

SEQ ID NO: 1835 - protein, 17 aa, Artificial Sequence
  candidate mimic peptide
STGGGASLELLEGKILP

SEQ ID NO: 1836 - protein, 10 aa, Artificial Sequence
  candidate mimic peptide
STGVPHILEH

SEQ ID NO: 1837 - protein, 12 aa, Artificial Sequence
  candidate mimic peptide
STNHKDIGTLYL

SEQ ID NO: 1838 - protein, 15 aa, Artificial Sequence
  candidate mimic peptide
SVAFDLATHRGYDSD

SEQ ID NO: 1839 - protein, 15 aa, Artificial Sequence
  candidate mimic peptide
SVFAGVGERTREGND

SEQ ID NO: 1840 - protein, 16 aa, Artificial Sequence
  candidate mimic peptide
SVFAGVGERTREGNDL

SEQ ID NO: 1841 - protein, 9 aa, Artificial Sequence
  candidate mimic peptide
SVLEMSHRS

SEQ ID NO: 1842 - protein, 14 aa, Artificial Sequence
  candidate mimic peptide
SVLFVCLGNICRSP

SEQ ID NO: 1843 - protein, 9 aa, Artificial Sequence
  candidate mimic peptide
SVSDKTGLV

SEQ ID NO: 1844 - protein, 10 aa, Artificial Sequence
  candidate mimic peptide
SVSDKTGLVE

SEQ ID NO: 1845 - protein, 10 aa, Artificial Sequence
  candidate mimic peptide
SVVGTSSLRR

SEQ ID NO: 1846 - protein, 9 aa, Artificial Sequence
  candidate mimic peptide
SYAAVPLYR

SEQ ID NO: 1847 - protein, 9 aa, Artificial Sequence
  candidate mimic peptide
SYEARAFGV

SEQ ID NO: 1848 - protein, 9 aa, Artificial Sequence
  candidate mimic peptide
TAARGRGKS

SEQ ID NO: 1849 - protein, 10 aa, Artificial Sequence
  candidate mimic peptide
TAMTGDGVND

SEQ ID NO: 1850 - protein, 9 aa, Artificial Sequence
  candidate mimic peptide
TAVLIETLV

SEQ ID NO: 1851 - protein, 11 aa, Artificial Sequence
  candidate mimic peptide
TDGERILGLGD

SEQ ID NO: 1852 - protein, 9 aa, Artificial Sequence
  candidate mimic peptide
TDGVGTKLK

SEQ ID NO: 1853 - protein, 9 aa, Artificial Sequence
  candidate mimic peptide
TDKTGTLTQ

SEQ ID NO: 1854 - protein, 9 aa, Artificial Sequence
  candidate mimic peptide
TDTWISMGQ

SEQ ID NO: 1855 - protein, 10 aa, Artificial Sequence
  candidate mimic peptide
TDTWISMGQE

SEQ ID NO: 1856 - protein, 9 aa, Artificial Sequence
  candidate mimic peptide
TDVTNASRT

SEQ ID NO: 1857 - protein, 11 aa, Artificial Sequence
  candidate mimic peptide
TDVTNASRTML

SEQ ID NO: 1858 - protein, 14 aa, Artificial Sequence
  candidate mimic peptide
TDVTNASRTMLFNI

SEQ ID NO: 1859 - protein, 15 aa, Artificial Sequence
  candidate mimic peptide
TDVTNASRTMLFNIH

SEQ ID NO: 1860 - protein, 9 aa, Artificial Sequence
  candidate mimic peptide
TEGCRGEGG

SEQ ID NO: 1861 - protein, 11 aa, Artificial Sequence
  candidate mimic peptide
TEGCRGEGGIL

SEQ ID NO: 1862 - protein, 9 aa, Artificial Sequence
  candidate mimic peptide
TEPGAGSDV

SEQ ID NO: 1863 - protein, 9 aa, Artificial Sequence
  candidate mimic peptide
TERVLYYTG

SEQ ID NO: 1864 - protein, 10 aa, Artificial Sequence
  candidate mimic peptide
TFDSGGISIK

SEQ ID NO: 1865 - protein, 12 aa, Artificial Sequence
  candidate mimic peptide
TFGCGSAIASSS

SEQ ID NO: 1866 - protein, 9 aa, Artificial Sequence
  candidate mimic peptide
TFGFRGEAL

SEQ ID NO: 1867 - protein, 10 aa, Artificial Sequence
  candidate mimic peptide
TFGGNPMACA

SEQ ID NO: 1868 - protein, 13 aa, Artificial Sequence
  candidate mimic peptide
TFGLACCAVEMMH

SEQ ID NO: 1869 - protein, 9 aa, Artificial Sequence
  candidate mimic peptide
TFGPTFRAE

SEQ ID NO: 1870 - protein, 11 aa, Artificial Sequence
  candidate mimic peptide
TFGPTFRAENS

SEQ ID NO: 1871 - protein, 9 aa, Artificial Sequence
  candidate mimic peptide
TFNDDIQGT

SEQ ID NO: 1872 - protein, 9 aa, Artificial Sequence
  candidate mimic peptide
TFNMDEYVG

SEQ ID NO: 1873 - protein, 10 aa, Artificial Sequence
  candidate mimic peptide
TFNMDEYVGL

SEQ ID NO: 1874 - protein, 11 aa, Artificial Sequence
  candidate mimic peptide
TFNMDEYVGLP

SEQ ID NO: 1875 - protein, 9 aa, Artificial Sequence
  candidate mimic peptide
TFVAELKGL

SEQ ID NO: 1876 - protein, 9 aa, Artificial Sequence
  candidate mimic peptide
TGAAQGIGR

SEQ ID NO: 1877 - protein, 10 aa, Artificial Sequence
  candidate mimic peptide
TGAGISTASG

SEQ ID NO: 1878 - protein, 9 aa, Artificial Sequence
  candidate mimic peptide
TGARGLRSI

SEQ ID NO: 1879 - protein, 9 aa, Artificial Sequence
  candidate mimic peptide
TGASSGIGE

SEQ ID NO: 1880 - protein, 10 aa, Artificial Sequence
  candidate mimic peptide
TGASSGIGEE

SEQ ID NO: 1881 - protein, 9 aa, Artificial Sequence
  candidate mimic peptide
TGEISPGMI

SEQ ID NO: 1882 - protein, 9 aa, Artificial Sequence
  candidate mimic peptide
TGGIASGKS

SEQ ID NO: 1883 - protein, 9 aa, Artificial Sequence
  candidate mimic peptide
TGHAEVVRV

SEQ ID NO: 1884 - protein, 9 aa, Artificial Sequence
  candidate mimic peptide
TGIKVVDLL

SEQ ID NO: 1885 - protein, 12 aa, Artificial Sequence
  candidate mimic peptide
TGIKVVDLLAPY

SEQ ID NO: 1886 - protein, 13 aa, Artificial Sequence
  candidate mimic peptide
TGIKVVDLLAPYA

SEQ ID NO: 1887 - protein, 10 aa, Artificial Sequence
  candidate mimic peptide
TGLSGAGKTT

SEQ ID NO: 1888 - protein, 10 aa, Artificial Sequence
  candidate mimic peptide
TGPCGPCSEI

SEQ ID NO: 1889 - protein, 9 aa, Artificial Sequence
  candidate mimic peptide
TGPNMGGKS

SEQ ID NO: 1890 - protein, 11 aa, Artificial Sequence
  candidate mimic peptide
TGPNMGGKSTY

SEQ ID NO: 1891 - protein, 11 aa, Artificial Sequence
  candidate mimic peptide
TGPNMSGKSTY

SEQ ID NO: 1892 - protein, 22 aa, Artificial Sequence
  candidate mimic peptide
TGQDGSYLAEFLLEKGYEVHGI

SEQ ID NO: 1893 - protein, 10 aa, Artificial Sequence
  candidate mimic peptide
TGRKIIVDTY

SEQ ID NO: 1894 - protein, 10 aa, Artificial Sequence
  candidate mimic peptide
TGRTHQIRVH

SEQ ID NO: 1895 - protein, 11 aa, Artificial Sequence
  candidate mimic peptide
TGRTHQIRVHL

SEQ ID NO: 1896 - protein, 9 aa, Artificial Sequence
  candidate mimic peptide
TGSFKIRGA

SEQ ID NO: 1897 - protein, 9 aa, Artificial Sequence
  candidate mimic peptide
TGSGKSSLL

SEQ ID NO: 1898 - protein, 9 aa, Artificial Sequence
  candidate mimic peptide
TGSGKSTLL

SEQ ID NO: 1899 - protein, 9 aa, Artificial Sequence
  candidate mimic peptide
TGTDEHGLK

SEQ ID NO: 1900 - protein, 10 aa, Artificial Sequence
  candidate mimic peptide
TGTDEHGLKI

SEQ ID NO: 1901 - protein, 10 aa, Artificial Sequence
  candidate mimic peptide
TGTPVVGGLT

SEQ ID NO: 1902 - protein, 9 aa, Artificial Sequence
  candidate mimic peptide
THGSLEVGK

SEQ ID NO: 1903 - protein, 18 aa, Artificial Sequence
  candidate mimic peptide
THIRLNIFPDGGIARLRV

SEQ ID NO: 1904 - protein, 11 aa, Artificial Sequence
  candidate mimic peptide
THLGLPVFNTV

SEQ ID NO: 1905 - protein, 14 aa, Artificial Sequence
  candidate mimic peptide
THLGLPVFNTVKEA

SEQ ID NO: 1906 - protein, 9 aa, Artificial Sequence
  candidate mimic peptide
TIAFGIRNV

SEQ ID NO: 1907 - protein, 9 aa, Artificial Sequence
  candidate mimic peptide
TIGKGFQGV

SEQ ID NO: 1908 - protein, 15 aa, Artificial Sequence
  candidate mimic peptide
TIIEPTSGNTGIGLA

SEQ ID NO: 1909 - protein, 9 aa, Artificial Sequence
  candidate mimic peptide
TIMENIRFG

SEQ ID NO: 1910 - protein, 11 aa, Artificial Sequence
  candidate mimic peptide
TIMGHVDHGKT

SEQ ID NO: 1911 - protein, 9 aa, Artificial Sequence
  candidate mimic peptide
TITMVGDLK

SEQ ID NO: 1912 - protein, 9 aa, Artificial Sequence
  candidate mimic peptide
TKDGVTVAK

SEQ ID NO: 1913 - protein, 14 aa, Artificial Sequence
  candidate mimic peptide
TKTRAEVRGGGRKP

SEQ ID NO: 1914 - protein, 9 aa, Artificial Sequence
  candidate mimic peptide
TLAIIKPDA

SEQ ID NO: 1915 - protein, 10 aa, Artificial Sequence
  candidate mimic peptide
TLAIIKPDAV

SEQ ID NO: 1916 - protein, 11 aa, Artificial Sequence
  candidate mimic peptide
TLGGTCLNVGC

SEQ ID NO: 1917 - protein, 9 aa, Artificial Sequence
  candidate mimic peptide
TLLFANAGM

SEQ ID NO: 1918 - protein, 9 aa, Artificial Sequence
  candidate mimic peptide
TLLGQNVNS

SEQ ID NO: 1919 - protein, 10 aa, Artificial Sequence
  candidate mimic peptide
TLLGQNVNSF

SEQ ID NO: 1920 - protein, 9 aa, Artificial Sequence
  candidate mimic peptide
TLNFGPQHP

SEQ ID NO: 1921 - protein, 18 aa, Artificial Sequence
  candidate mimic peptide
TLNFGPQHPAAHGVLRLV

SEQ ID NO: 1922 - protein, 9 aa, Artificial Sequence
  candidate mimic peptide
TLVFDVELL

SEQ ID NO: 1923 - protein, 9 aa, Artificial Sequence
  candidate mimic peptide
TLVFEVELL

SEQ ID NO: 1924 - protein, 9 aa, Artificial Sequence
  candidate mimic peptide
TLYHWDLPQ

SEQ ID NO: 1925 - protein, 9 aa, Artificial Sequence
  candidate mimic peptide
TMLRVKDPK

SEQ ID NO: 1926 - protein, 9 aa, Artificial Sequence
  candidate mimic peptide
TMSTVGYGD

SEQ ID NO: 1927 - protein, 10 aa, Artificial Sequence
  candidate mimic peptide
TMYGQMTAGS

SEQ ID NO: 1928 - protein, 10 aa, Artificial Sequence
  candidate mimic peptide
TNAGKSTLFN

SEQ ID NO: 1929 - protein, 9 aa, Artificial Sequence
  candidate mimic peptide
TNASRTMLF

SEQ ID NO: 1930 - protein, 12 aa, Artificial Sequence
  candidate mimic peptide
TNASRTMLFNIH

SEQ ID NO: 1931 - protein, 14 aa, Artificial Sequence
  candidate mimic peptide
TNASRTMLFNIHSL

SEQ ID NO: 1932 - protein, 10 aa, Artificial Sequence
  candidate mimic peptide
TNGSQFFITT

SEQ ID NO: 1933 - protein, 9 aa, Artificial Sequence
  candidate mimic peptide
TNGSQFFLT

SEQ ID NO: 1934 - protein, 9 aa, Artificial Sequence
  candidate mimic peptide
TNPVDILTY

SEQ ID NO: 1935 - protein, 11 aa, Artificial Sequence
  candidate mimic peptide
TNVPGVFAAGD

SEQ ID NO: 1936 - protein, 10 aa, Artificial Sequence
  candidate mimic peptide
TPFYPRSPYG

SEQ ID NO: 1937 - protein, 11 aa, Artificial Sequence
  candidate mimic peptide
TPGVAADLSHI

SEQ ID NO: 1938 - protein, 15 aa, Artificial Sequence
  candidate mimic peptide
TPIINPPQSAILGMH

SEQ ID NO: 1939 - protein, 10 aa, Artificial Sequence
  candidate mimic peptide
TPIPHNGCRP

SEQ ID NO: 1940 - protein, 12 aa, Artificial Sequence
  candidate mimic peptide
TPIPHNGCRPRK

SEQ ID NO: 1941 - protein, 9 aa, Artificial Sequence
  candidate mimic peptide
TPTPLGEGK

SEQ ID NO: 1942 - protein, 9 aa, Artificial Sequence
  candidate mimic peptide
TPVFMPVGT

SEQ ID NO: 1943 - protein, 10 aa, Artificial Sequence
  candidate mimic peptide
TPVFMPVGTQ

SEQ ID NO: 1944 - protein, 12 aa, Artificial Sequence
  candidate mimic peptide
TPVFMPVGTQAT

SEQ ID NO: 1945 - protein, 11 aa, Artificial Sequence
  candidate mimic peptide
TPVPGGVGPMT

SEQ ID NO: 1946 - protein, 9 aa, Artificial Sequence
  candidate mimic peptide
TQGKGLMPD

SEQ ID NO: 1947 - protein, 11 aa, Artificial Sequence
  candidate mimic peptide
TQGKGLMPDGT

SEQ ID NO: 1948 - protein, 9 aa, Artificial Sequence
  candidate mimic peptide
TQIPILTMP

SEQ ID NO: 1949 - protein, 14 aa, Artificial Sequence
  candidate mimic peptide
TQKCIRAGGKHNDL

SEQ ID NO: 1950 - protein, 9 aa, Artificial Sequence
  candidate mimic peptide
TQNVDALHT

SEQ ID NO: 1951 - protein, 9 aa, Artificial Sequence
  candidate mimic peptide
TRLTESGLS

SEQ ID NO: 1952 - protein, 9 aa, Artificial Sequence
  candidate mimic peptide
TRVGGIPEV

SEQ ID NO: 1953 - protein, 9 aa, Artificial Sequence
  candidate mimic peptide
TSGATESNN

SEQ ID NO: 1954 - protein, 9 aa, Artificial Sequence
  candidate mimic peptide
TSGSTGKPK

SEQ ID NO: 1955 - protein, 11 aa, Artificial Sequence
  candidate mimic peptide
TSGSTGKPKGV

SEQ ID NO: 1956 - protein, 9 aa, Artificial Sequence
  candidate mimic peptide
TSGSTGLPK

SEQ ID NO: 1957 - protein, 12 aa, Artificial Sequence
  candidate mimic peptide
TSGSTGRPKGVM

SEQ ID NO: 1958 - protein, 9 aa, Artificial Sequence
  candidate mimic peptide
TSGTTGFPK

SEQ ID NO: 1959 - protein, 9 aa, Artificial Sequence
  candidate mimic peptide
TSGTTGLPK

SEQ ID NO: 1960 - protein, 11 aa, Artificial Sequence
  candidate mimic peptide
TSGTTGLPKGV

SEQ ID NO: 1961 - protein, 9 aa, Artificial Sequence
  candidate mimic peptide
TSGTTGNPK

SEQ ID NO: 1962 - protein, 11 aa, Artificial Sequence
  candidate mimic peptide
TSVLKRAIRTL

SEQ ID NO: 1963 - protein, 10 aa, Artificial Sequence
  candidate mimic peptide
TTRSPREGEV

SEQ ID NO: 1964 - protein, 10 aa, Artificial Sequence
  candidate mimic peptide
TTTTHKTLRG

SEQ ID NO: 1965 - protein, 9 aa, Artificial Sequence
  candidate mimic peptide
TTVVADTGD

SEQ ID NO: 1966 - protein, 10 aa, Artificial Sequence
  candidate mimic peptide
TTVVADTGDF

SEQ ID NO: 1967 - protein, 9 aa, Artificial Sequence
  candidate mimic peptide
TVIGGGDTA

SEQ ID NO: 1968 - protein, 10 aa, Artificial Sequence
  candidate mimic peptide
TVLIMELINN

SEQ ID NO: 1969 - protein, 9 aa, Artificial Sequence
  candidate mimic peptide
TVPAYFNDA

SEQ ID NO: 1970 - protein, 11 aa, Artificial Sequence
  candidate mimic peptide
TVPAYFNDAQR

SEQ ID NO: 1971 - protein, 15 aa, Artificial Sequence
  candidate mimic peptide
TVPAYFNDAQRQATK

SEQ ID NO: 1972 - protein, 18 aa, Artificial Sequence
  candidate mimic peptide
TVPAYFNDAQRQATKDAG

SEQ ID NO: 1973 - protein, 10 aa, Artificial Sequence
  candidate mimic peptide
TWRLNERHYG

SEQ ID NO: 1974 - protein, 9 aa, Artificial Sequence
  candidate mimic peptide
TYGCQMNVN

SEQ ID NO: 1975 - protein, 9 aa, Artificial Sequence
  candidate mimic peptide
TYGGNPLGC

SEQ ID NO: 1976 - protein, 9 aa, Artificial Sequence
  candidate mimic peptide
TYGTGCFLL

SEQ ID NO: 1977 - protein, 11 aa, Artificial Sequence
  candidate mimic peptide
TYNKDLQEDKE

SEQ ID NO: 1978 - protein, 9 aa, Artificial Sequence
  candidate mimic peptide
TYPLIGNYG

SEQ ID NO: 1979 - protein, 10 aa, Artificial Sequence
  candidate mimic peptide
TYPLIGNYGI

SEQ ID NO: 1980 - protein, 10 aa, Artificial Sequence
  candidate mimic peptide
VAAGGRYDGL

SEQ ID NO: 1981 - protein, 11 aa, Artificial Sequence
  candidate mimic peptide
VAAGGRYDGLV

SEQ ID NO: 1982 - protein, 9 aa, Artificial Sequence
  candidate mimic peptide
VAGETGSGK

SEQ ID NO: 1983 - protein, 9 aa, Artificial Sequence
  candidate mimic peptide
VAGGMENMS

SEQ ID NO: 1984 - protein, 13 aa, Artificial Sequence
  candidate mimic peptide
VALLSGGGSGHEP

SEQ ID NO: 1985 - protein, 10 aa, Artificial Sequence
  candidate mimic peptide
VAMVGDGIND

SEQ ID NO: 1986 - protein, 9 aa, Artificial Sequence
  candidate mimic peptide
VAPGNAGTA

SEQ ID NO: 1987 - protein, 9 aa, Artificial Sequence
  candidate mimic peptide
VASEIMAVL

SEQ ID NO: 1988 - protein, 9 aa, Artificial Sequence
  candidate mimic peptide
VASYPFTTL

SEQ ID NO: 1989 - protein, 12 aa, Artificial Sequence
  candidate mimic peptide
VATPVFMPVGTQ

SEQ ID NO: 1990 - protein, 10 aa, Artificial Sequence
  candidate mimic peptide
VAVYNHYKRI

SEQ ID NO: 1991 - protein, 9 aa, Artificial Sequence
  candidate mimic peptide
VDAIVNAAN

SEQ ID NO: 1992 - protein, 10 aa, Artificial Sequence
  candidate mimic peptide
VDDLLATGGT

SEQ ID NO: 1993 - protein, 11 aa, Artificial Sequence
  candidate mimic peptide
VDDLLATGGTM

SEQ ID NO: 1994 - protein, 12 aa, Artificial Sequence
  candidate mimic peptide
VDDLLATGGTMN

SEQ ID NO: 1995 - protein, 11 aa, Artificial Sequence
  candidate mimic peptide
VDGKDVMPEVN

SEQ ID NO: 1996 - protein, 9 aa, Artificial Sequence
  candidate mimic peptide
VDILVNNAG

SEQ ID NO: 1997 - protein, 10 aa, Artificial Sequence
  candidate mimic peptide
VDILVNNAGI

SEQ ID NO: 1998 - protein, 11 aa, Artificial Sequence
  candidate mimic peptide
VDKHSTGGVGD

SEQ ID NO: 1999 - protein, 9 aa, Artificial Sequence
  candidate mimic peptide
VDPLDGTKE

SEQ ID NO: 2000 - protein, 9 aa, Artificial Sequence
  candidate mimic peptide
VDQETGEDL

SEQ ID NO: 2001 - protein, 9 aa, Artificial Sequence
  candidate mimic peptide
VDQHAAHER

SEQ ID NO: 2002 - protein, 12 aa, Artificial Sequence
  candidate mimic peptide
VDTWWQTETGGI

SEQ ID NO: 2003 - protein, 9 aa, Artificial Sequence
  candidate mimic peptide
VDVLVNNAG

SEQ ID NO: 2004 - protein, 9 aa, Artificial Sequence
  candidate mimic peptide
VDVNVHPTK

SEQ ID NO: 2005 - protein, 12 aa, Artificial Sequence
  candidate mimic peptide
VDVNVHPTKHEV

SEQ ID NO: 2006 - protein, 9 aa, Artificial Sequence
  candidate mimic peptide
VEFSRNVLG

SEQ ID NO: 2007 - protein, 13 aa, Artificial Sequence
  candidate mimic peptide
VEGDSAFGFSGME

SEQ ID NO: 2008 - protein, 10 aa, Artificial Sequence
  candidate mimic peptide
VEIAGPGFIN

SEQ ID NO: 2009 - protein, 11 aa, Artificial Sequence
  candidate mimic peptide
VEIAGPGFINV

SEQ ID NO: 2010 - protein, 9 aa, Artificial Sequence
  candidate mimic peptide
VELCGALKN

SEQ ID NO: 2011 - protein, 12 aa, Artificial Sequence
  candidate mimic peptide
VELNRKVLADLA

SEQ ID NO: 2012 - protein, 9 aa, Artificial Sequence
  candidate mimic peptide
VEPIQGEAG

SEQ ID NO: 2013 - protein, 13 aa, Artificial Sequence
  candidate mimic peptide
VEVGPRDGLQNEK

SEQ ID NO: 2014 - protein, 10 aa, Artificial Sequence
  candidate mimic peptide
VEVNCETDFV

SEQ ID NO: 2015 - protein, 10 aa, Artificial Sequence
  candidate mimic peptide
VFDLGGGTFD

SEQ ID NO: 2016 - protein, 11 aa, Artificial Sequence
  candidate mimic peptide
VFTFGPTFRAE

SEQ ID NO: 2017 - protein, 11 aa, Artificial Sequence
  candidate mimic peptide
VGAGSAGCVLA

SEQ ID NO: 2018 - protein, 10 aa, Artificial Sequence
  candidate mimic peptide
VGASGDLAPL

SEQ ID NO: 2019 - protein, 12 aa, Artificial Sequence
  candidate mimic peptide
VGASGDLAPLSH

SEQ ID NO: 2020 - protein, 10 aa, Artificial Sequence
  candidate mimic peptide
VGDEGGFAPN

SEQ ID NO: 2021 - protein, 9 aa, Artificial Sequence
  candidate mimic peptide
VGDVRGKGL

SEQ ID NO: 2022 - protein, 10 aa, Artificial Sequence
  candidate mimic peptide
VGFPSVGKST

SEQ ID NO: 2023 - protein, 13 aa, Artificial Sequence
  candidate mimic peptide
VGFPSVGKSTLLS

SEQ ID NO: 2024 - protein, 11 aa, Artificial Sequence
  candidate mimic peptide
VGGIRASLYNA

SEQ ID NO: 2025 - protein, 9 aa, Artificial Sequence
  candidate mimic peptide
VGGRYSLWS

SEQ ID NO: 2026 - protein, 9 aa, Artificial Sequence
  candidate mimic peptide
VGICGSDVH

SEQ ID NO: 2027 - protein, 10 aa, Artificial Sequence
  candidate mimic peptide
VGICGSDVHY

SEQ ID NO: 2028 - protein, 11 aa, Artificial Sequence
  candidate mimic peptide
VGINGFGRIGR

SEQ ID NO: 2029 - protein, 12 aa, Artificial Sequence
  candidate mimic peptide
VGINGFGRIGRL

SEQ ID NO: 2030 - protein, 14 aa, Artificial Sequence
  candidate mimic peptide
VGINGFGRIGRLVL

SEQ ID NO: 2031 - protein, 15 aa, Artificial Sequence
  candidate mimic peptide
VGINGFGRIGRLVLR

SEQ ID NO: 2032 - protein, 11 aa, Artificial Sequence
  candidate mimic peptide
VGKGITFDSGG

SEQ ID NO: 2033 - protein, 13 aa, Artificial Sequence
  candidate mimic peptide
VGKGITFDSGGIS

SEQ ID NO: 2034 - protein, 15 aa, Artificial Sequence
  candidate mimic peptide
VGKGITFDSGGISIK

SEQ ID NO: 2035 - protein, 10 aa, Artificial Sequence
  candidate mimic peptide
VGKSSFINKV

SEQ ID NO: 2036 - protein, 11 aa, Artificial Sequence
  candidate mimic peptide
VGLGNIWRFPY

SEQ ID NO: 2037 - protein, 9 aa, Artificial Sequence
  candidate mimic peptide
VGLPAKSGV

SEQ ID NO: 2038 - protein, 11 aa, Artificial Sequence
  candidate mimic peptide
VGLTGGIASGK

SEQ ID NO: 2039 - protein, 12 aa, Artificial Sequence
  candidate mimic peptide
VGLTGGIASGKS

SEQ ID NO: 2040 - protein, 9 aa, Artificial Sequence
  candidate mimic peptide
VGRLKTGTP

SEQ ID NO: 2041 - protein, 12 aa, Artificial Sequence
  candidate mimic peptide
VGRLKTGTPPRI

SEQ ID NO: 2042 - protein, 11 aa, Artificial Sequence
  candidate mimic peptide
VGRNIIHGSDS

SEQ ID NO: 2043 - protein, 9 aa, Artificial Sequence
  candidate mimic peptide
VGTDSHTTM

SEQ ID NO: 2044 - protein, 9 aa, Artificial Sequence
  candidate mimic peptide
VGTGGTITG

SEQ ID NO: 2045 - protein, 9 aa, Artificial Sequence
  candidate mimic peptide
VGTSSLRRA

SEQ ID NO: 2046 - protein, 12 aa, Artificial Sequence
  candidate mimic peptide
VGTSSLRRAAQL

SEQ ID NO: 2047 - protein, 9 aa, Artificial Sequence
  candidate mimic peptide
VHAENGELV

SEQ ID NO: 2048 - protein, 9 aa, Artificial Sequence
  candidate mimic peptide
VHRDIKPGN

SEQ ID NO: 2049 - protein, 9 aa, Artificial Sequence
  candidate mimic peptide
VHRDLKPAN

SEQ ID NO: 2050 - protein, 11 aa, Artificial Sequence
  candidate mimic peptide
VHRDLKPQNIL

SEQ ID NO: 2051 - protein, 9 aa, Artificial Sequence
  candidate mimic peptide
VHRDLKPSN

SEQ ID NO: 2052 - protein, 9 aa, Artificial Sequence
  candidate mimic peptide
VHSLKDLPT

SEQ ID NO: 2053 - protein, 14 aa, Artificial Sequence
  candidate mimic peptide
VHSLKDLPTVLPPG

SEQ ID NO: 2054 - protein, 9 aa, Artificial Sequence
  candidate mimic peptide
VIAHRLSTI

SEQ ID NO: 2055 - protein, 9 aa, Artificial Sequence
  candidate mimic peptide
VIAHRLSTV

SEQ ID NO: 2056 - protein, 10 aa, Artificial Sequence
  candidate mimic peptide
VIGAVVDVQF

SEQ ID NO: 2057 - protein, 9 aa, Artificial Sequence
  candidate mimic peptide
VIGKGGETI

SEQ ID NO: 2058 - protein, 14 aa, Artificial Sequence
  candidate mimic peptide
VIHFAGLKAVGESV

SEQ ID NO: 2059 - protein, 18 aa, Artificial Sequence
  candidate mimic peptide
VIHFAGLKAVGESVQKPL

SEQ ID NO: 2060 - protein, 9 aa, Artificial Sequence
  candidate mimic peptide
VILDEPTAG

SEQ ID NO: 2061 - protein, 9 aa, Artificial Sequence
  candidate mimic peptide
VILGQDPYH

SEQ ID NO: 2062 - protein, 10 aa, Artificial Sequence
  candidate mimic peptide
VILGQDPYHG

SEQ ID NO: 2063 - protein, 11 aa, Artificial Sequence
  candidate mimic peptide
VILGQDPYHGP

SEQ ID NO: 2064 - protein, 9 aa, Artificial Sequence
  candidate mimic peptide
VILTTGTFL

SEQ ID NO: 2065 - protein, 10 aa, Artificial Sequence
  candidate mimic peptide
VILVGENPAS

SEQ ID NO: 2066 - protein, 11 aa, Artificial Sequence
  candidate mimic peptide
VIVVGNPANTN

SEQ ID NO: 2067 - protein, 10 aa, Artificial Sequence
  candidate mimic peptide
VKAQKVRRLI

SEQ ID NO: 2068 - protein, 11 aa, Artificial Sequence
  candidate mimic peptide
VKELVENSLDA

SEQ ID NO: 2069 - protein, 13 aa, Artificial Sequence
  candidate mimic peptide
VKELVENSLDAGA

SEQ ID NO: 2070 - protein, 10 aa, Artificial Sequence
  candidate mimic peptide
VKLSDYKGKY

SEQ ID NO: 2071 - protein, 10 aa, Artificial Sequence
  candidate mimic peptide
VKMVHNGIEY

SEQ ID NO: 2072 - protein, 16 aa, Artificial Sequence
  candidate mimic peptide
VKMVHNGIEYGDMQLI

SEQ ID NO: 2073 - protein, 13 aa, Artificial Sequence
  candidate mimic peptide
VKRTGAIVDVPVG

SEQ ID NO: 2074 - protein, 9 aa, Artificial Sequence
  candidate mimic peptide
VKSTLGPKG

SEQ ID NO: 2075 - protein, 11 aa, Artificial Sequence
  candidate mimic peptide
VKVVILGQDPY

SEQ ID NO: 2076 - protein, 12 aa, Artificial Sequence
  candidate mimic peptide
VKVVILGQDPYH

SEQ ID NO: 2077 - protein, 13 aa, Artificial Sequence
  candidate mimic peptide
VKVVILGQDPYHG

SEQ ID NO: 2078 - protein, 14 aa, Artificial Sequence
  candidate mimic peptide
VKVVILGQDPYHGP

SEQ ID NO: 2079 - protein, 17 aa, Artificial Sequence
  candidate mimic peptide
VKVVILGQDPYHGPNQA

SEQ ID NO: 2080 - protein, 19 aa, Artificial Sequence
  candidate mimic peptide
VKVVILGQDPYHGPNQAHG

SEQ ID NO: 2081 - protein, 20 aa, Artificial Sequence
  candidate mimic peptide
VKVVILGQDPYHGPNQAHGL

SEQ ID NO: 2082 - protein, 24 aa, Artificial Sequence
  candidate mimic peptide
VKVVILGQDPYHGPNQAHGLCFSV

SEQ ID NO: 2083 - protein, 25 aa, Artificial Sequence
  candidate mimic peptide
VKVVILGQDPYHGPNQAHGLCFSVQ

SEQ ID NO: 2084 - protein, 11 aa, Artificial Sequence
  candidate mimic peptide
VKYSPDCIIIV

SEQ ID NO: 2085 - protein, 9 aa, Artificial Sequence
  candidate mimic peptide
VLASASPRR

SEQ ID NO: 2086 - protein, 9 aa, Artificial Sequence
  candidate mimic peptide
VLATNIAET

SEQ ID NO: 2087 - protein, 16 aa, Artificial Sequence
  candidate mimic peptide
VLAYEPVWAIGTGKTA

SEQ ID NO: 2088 - protein, 10 aa, Artificial Sequence
  candidate mimic peptide
VLAYSGGLDT

SEQ ID NO: 2089 - protein, 11 aa, Artificial Sequence
  candidate mimic peptide
VLAYSGGLDTS

SEQ ID NO: 2090 - protein, 11 aa, Artificial Sequence
  candidate mimic peptide
VLDGGMGTMIQ

SEQ ID NO: 2091 - protein, 9 aa, Artificial Sequence
  candidate mimic peptide
VLDVGCGSG

SEQ ID NO: 2092 - protein, 12 aa, Artificial Sequence
  candidate mimic peptide
VLDVGCGSGILS

SEQ ID NO: 2093 - protein, 12 aa, Artificial Sequence
  candidate mimic peptide
VLEARDRVGGRT

SEQ ID NO: 2094 - protein, 9 aa, Artificial Sequence
  candidate mimic peptide
VLFIADEIQ

SEQ ID NO: 2095 - protein, 12 aa, Artificial Sequence
  candidate mimic peptide
VLFIADEIQTGL

SEQ ID NO: 2096 - protein, 13 aa, Artificial Sequence
  candidate mimic peptide
VLGAQWGDEGKGK

SEQ ID NO: 2097 - protein, 9 aa, Artificial Sequence
  candidate mimic peptide
VLGEHGDSS

SEQ ID NO: 2098 - protein, 9 aa, Artificial Sequence
  candidate mimic peptide
VLGFPCNQF

SEQ ID NO: 2099 - protein, 9 aa, Artificial Sequence
  candidate mimic peptide
VLGIETSCD

SEQ ID NO: 2100 - protein, 11 aa, Artificial Sequence
  candidate mimic peptide
VLIIGSGGREH

SEQ ID NO: 2101 - protein, 9 aa, Artificial Sequence
  candidate mimic peptide
VLILDEATS

SEQ ID NO: 2102 - protein, 12 aa, Artificial Sequence
  candidate mimic peptide
VLITGCSSGIGL

SEQ ID NO: 2103 - protein, 9 aa, Artificial Sequence
  candidate mimic peptide
VLIVEDIID

SEQ ID NO: 2104 - protein, 11 aa, Artificial Sequence
  candidate mimic peptide
VLIVEDIIDTG

SEQ ID NO: 2105 - protein, 14 aa, Artificial Sequence
  candidate mimic peptide
VLLGPPGAGKGTQA

SEQ ID NO: 2106 - protein, 15 aa, Artificial Sequence
  candidate mimic peptide
VLNGNEIGGGSIRIH

SEQ ID NO: 2107 - protein, 9 aa, Artificial Sequence
  candidate mimic peptide
VLPIIVFFS

SEQ ID NO: 2108 - protein, 10 aa, Artificial Sequence
  candidate mimic peptide
VLRSSIREFL

SEQ ID NO: 2109 - protein, 15 aa, Artificial Sequence
  candidate mimic peptide
VLRSSIREFLCSEAM

SEQ ID NO: 2110 - protein, 10 aa, Artificial Sequence
  candidate mimic peptide
VLSGGEKQRI

SEQ ID NO: 2111 - protein, 10 aa, Artificial Sequence
  candidate mimic peptide
VLSGPSGAGK

SEQ ID NO: 2112 - protein, 9 aa, Artificial Sequence
  candidate mimic peptide
VLTSVDRDD

SEQ ID NO: 2113 - protein, 12 aa, Artificial Sequence
  candidate mimic peptide
VLTVRAHQANSH

SEQ ID NO: 2114 - protein, 12 aa, Artificial Sequence
  candidate mimic peptide
VLVEVNCETDFV

SEQ ID NO: 2115 - protein, 9 aa, Artificial Sequence
  candidate mimic peptide
VLVKIAPDL

SEQ ID NO: 2116 - protein, 9 aa, Artificial Sequence
  candidate mimic peptide
VMEGFLRLR

SEQ ID NO: 2117 - protein, 9 aa, Artificial Sequence
  candidate mimic peptide
VMENGKVIE

SEQ ID NO: 2118 - protein, 11 aa, Artificial Sequence
  candidate mimic peptide
VMITGDNPLTA

SEQ ID NO: 2119 - protein, 9 aa, Artificial Sequence
  candidate mimic peptide
VMQEEIFGP

SEQ ID NO: 2120 - protein, 16 aa, Artificial Sequence
  candidate mimic peptide
VNAANSSLLGGGGVDG

SEQ ID NO: 2121 - protein, 11 aa, Artificial Sequence
  candidate mimic peptide
VNCNPETVSTD

SEQ ID NO: 2122 - protein, 10 aa, Artificial Sequence
  candidate mimic peptide
VNDAFGTAHR

SEQ ID NO: 2123 - protein, 11 aa, Artificial Sequence
  candidate mimic peptide
VNDAFGTAHRA

SEQ ID NO: 2124 - protein, 12 aa, Artificial Sequence
  candidate mimic peptide
VNDAFGTAHRAH

SEQ ID NO: 2125 - protein, 10 aa, Artificial Sequence
  candidate mimic peptide
VNGAGLAMAT

SEQ ID NO: 2126 - protein, 11 aa, Artificial Sequence
  candidate mimic peptide
VNGVAKIHSDI

SEQ ID NO: 2127 - protein, 9 aa, Artificial Sequence
  candidate mimic peptide
VNKSQSSND

SEQ ID NO: 2128 - protein, 10 aa, Artificial Sequence
  candidate mimic peptide
VNKSQSSNDT

SEQ ID NO: 2129 - protein, 16 aa, Artificial Sequence
  candidate mimic peptide
VNKSQSSNDTFPTAMH

SEQ ID NO: 2130 - protein, 19 aa, Artificial Sequence
  candidate mimic peptide
VNKSQSSNDTFPTAMHIAA

SEQ ID NO: 2131 - protein, 11 aa, Artificial Sequence
  candidate mimic peptide
VNLTNHSYFNL

SEQ ID NO: 2132 - protein, 10 aa, Artificial Sequence
  candidate mimic peptide
VNQGHCHPKI

SEQ ID NO: 2133 - protein, 9 aa, Artificial Sequence
  candidate mimic peptide
VNRIAAGEV

SEQ ID NO: 2134 - protein, 9 aa, Artificial Sequence
  candidate mimic peptide
VNTTDSAVR

SEQ ID NO: 2135 - protein, 10 aa, Artificial Sequence
  candidate mimic peptide
VNTTDSAVRI

SEQ ID NO: 2136 - protein, 9 aa, Artificial Sequence
  candidate mimic peptide
VNVQGTRNV

SEQ ID NO: 2137 - protein, 9 aa, Artificial Sequence
  candidate mimic peptide
VPAGVEDGQ

SEQ ID NO: 2138 - protein, 9 aa, Artificial Sequence
  candidate mimic peptide
VPEEYGGLG

SEQ ID NO: 2139 - protein, 9 aa, Artificial Sequence
  candidate mimic peptide
VPESPRWLI

SEQ ID NO: 2140 - protein, 10 aa, Artificial Sequence
  candidate mimic peptide
VPETKGKTLE

SEQ ID NO: 2141 - protein, 11 aa, Artificial Sequence
  candidate mimic peptide
VPETKGRSLEQ

SEQ ID NO: 2142 - protein, 9 aa, Artificial Sequence
  candidate mimic peptide
VPGGFGIRG

SEQ ID NO: 2143 - protein, 14 aa, Artificial Sequence
  candidate mimic peptide
VPIGRGQRELIIGD

SEQ ID NO: 2144 - protein, 20 aa, Artificial Sequence
  candidate mimic peptide
VPIGRGQRELIIGDRQTGKT

SEQ ID NO: 2145 - protein, 10 aa, Artificial Sequence
  candidate mimic peptide
VPLIGFAGAP

SEQ ID NO: 2146 - protein, 12 aa, Artificial Sequence
  candidate mimic peptide
VPVGEELLGRVV

SEQ ID NO: 2147 - protein, 12 aa, Artificial Sequence
  candidate mimic peptide
VQSLGGTGALRI

SEQ ID NO: 2148 - protein, 12 aa, Artificial Sequence
  candidate mimic peptide
VRENTEGEYSSL

SEQ ID NO: 2149 - protein, 9 aa, Artificial Sequence
  candidate mimic peptide
VRFAPSPTG

SEQ ID NO: 2150 - protein, 9 aa, Artificial Sequence
  candidate mimic peptide
VRFSTVAGE

SEQ ID NO: 2151 - protein, 9 aa, Artificial Sequence
  candidate mimic peptide
VRGGGRKPW

SEQ ID NO: 2152 - protein, 10 aa, Artificial Sequence
  candidate mimic peptide
VRGKDVFIIQ

SEQ ID NO: 2153 - protein, 9 aa, Artificial Sequence
  candidate mimic peptide
VRGVAMNPV

SEQ ID NO: 2154 - protein, 11 aa, Artificial Sequence
  candidate mimic peptide
VRVRFAPSPTG

SEQ ID NO: 2155 - protein, 12 aa, Artificial Sequence
  candidate mimic peptide
VRVRFAPSPTGF

SEQ ID NO: 2156 - protein, 14 aa, Artificial Sequence
  candidate mimic peptide
VRVRFAPSPTGFLH

SEQ ID NO: 2157 - protein, 10 aa, Artificial Sequence
  candidate mimic peptide
VSEAGASIYS

SEQ ID NO: 2158 - protein, 10 aa, Artificial Sequence
  candidate mimic peptide
VSEDMLGRVF

SEQ ID NO: 2159 - protein, 9 aa, Artificial Sequence
  candidate mimic peptide
VSGGTDNHL

SEQ ID NO: 2160 - protein, 17 aa, Artificial Sequence
  candidate mimic peptide
VSHGATGKGNDQVRFEL

SEQ ID NO: 2161 - protein, 10 aa, Artificial Sequence
  candidate mimic peptide
VSNHGGRQLD

SEQ ID NO: 2162 - protein, 10 aa, Artificial Sequence
  candidate mimic peptide
VSNPVDILTY

SEQ ID NO: 2163 - protein, 11 aa, Artificial Sequence
  candidate mimic peptide
VSNPVDILTYV

SEQ ID NO: 2164 - protein, 9 aa, Artificial Sequence
  candidate mimic peptide
VSSDRGLCG

SEQ ID NO: 2165 - protein, 14 aa, Artificial Sequence
  candidate mimic peptide
VTAGLAIYDTMQYI

SEQ ID NO: 2166 - protein, 9 aa, Artificial Sequence
  candidate mimic peptide
VTFHRAFDM

SEQ ID NO: 2167 - protein, 13 aa, Artificial Sequence
  candidate mimic peptide
VTGAAGQIAYSLL

SEQ ID NO: 2168 - protein, 10 aa, Artificial Sequence
  candidate mimic peptide
VTGAAQGIGR

SEQ ID NO: 2169 - protein, 9 aa, Artificial Sequence
  candidate mimic peptide
VTGAGKGIG

SEQ ID NO: 2170 - protein, 9 aa, Artificial Sequence
  candidate mimic peptide
VTGAGSGIG

SEQ ID NO: 2171 - protein, 9 aa, Artificial Sequence
  candidate mimic peptide
VTGASRGIG

SEQ ID NO: 2172 - protein, 10 aa, Artificial Sequence
  candidate mimic peptide
VTGASRGIGR

SEQ ID NO: 2173 - protein, 9 aa, Artificial Sequence
  candidate mimic peptide
VTGASSGIG

SEQ ID NO: 2174 - protein, 10 aa, Artificial Sequence
  candidate mimic peptide
VTGASSGIGE

SEQ ID NO: 2175 - protein, 9 aa, Artificial Sequence
  candidate mimic peptide
VTGSTSGIG

SEQ ID NO: 2176 - protein, 13 aa, Artificial Sequence
  candidate mimic peptide
VTILGHVQRGGTP

SEQ ID NO: 2177 - protein, 12 aa, Artificial Sequence
  candidate mimic peptide
VTIMGHVDHGKT

SEQ ID NO: 2178 - protein, 10 aa, Artificial Sequence
  candidate mimic peptide
VTLELGGKNP

SEQ ID NO: 2179 - protein, 10 aa, Artificial Sequence
  candidate mimic peptide
VTLELGGKSP

SEQ ID NO: 2180 - protein, 10 aa, Artificial Sequence
  candidate mimic peptide
VTLYHWDLPQ

SEQ ID NO: 2181 - protein, 11 aa, Artificial Sequence
  candidate mimic peptide
VTTTTHKTLRG

SEQ ID NO: 2182 - protein, 10 aa, Artificial Sequence
  candidate mimic peptide
VVAGETGSGK

SEQ ID NO: 2183 - protein, 9 aa, Artificial Sequence
  candidate mimic peptide
VVAHRLSTV

SEQ ID NO: 2184 - protein, 11 aa, Artificial Sequence
  candidate mimic peptide
VVAIGECGLDF

SEQ ID NO: 2185 - protein, 11 aa, Artificial Sequence
  candidate mimic peptide
VVDDLLATGGT

SEQ ID NO: 2186 - protein, 9 aa, Artificial Sequence
  candidate mimic peptide
VVGNPANTN

SEQ ID NO: 2187 - protein, 13 aa, Artificial Sequence
  candidate mimic peptide
VVGPEAPLAAGIV

SEQ ID NO: 2188 - protein, 9 aa, Artificial Sequence
  candidate mimic peptide
VVGTSSLRR

SEQ ID NO: 2189 - protein, 9 aa, Artificial Sequence
  candidate mimic peptide
VVIGADTIV

SEQ ID NO: 2190 - protein, 11 aa, Artificial Sequence
  candidate mimic peptide
VVILGQDPYHG

SEQ ID NO: 2191 - protein, 15 aa, Artificial Sequence
  candidate mimic peptide
VVILGQDPYHGPNQA

SEQ ID NO: 2192 - protein, 18 aa, Artificial Sequence
  candidate mimic peptide
VVILGQDPYHGPNQAHGL

SEQ ID NO: 2193 - protein, 10 aa, Artificial Sequence
  candidate mimic peptide
VVIVRDDLLG

SEQ ID NO: 2194 - protein, 9 aa, Artificial Sequence
  candidate mimic peptide
VVKHEVTGL

SEQ ID NO: 2195 - protein, 12 aa, Artificial Sequence
  candidate mimic peptide
VVKRLPKTRSGK

SEQ ID NO: 2196 - protein, 11 aa, Artificial Sequence
  candidate mimic peptide
VVLAYSGGLDT

SEQ ID NO: 2197 - protein, 12 aa, Artificial Sequence
  candidate mimic peptide
VVLAYSGGLDTS

SEQ ID NO: 2198 - protein, 14 aa, Artificial Sequence
  candidate mimic peptide
VVLGAQWGDEGKGK

SEQ ID NO: 2199 - protein, 9 aa, Artificial Sequence
  candidate mimic peptide
VVLGHSERR

SEQ ID NO: 2200 - protein, 9 aa, Artificial Sequence
  candidate mimic peptide
VVLVGGSTR

SEQ ID NO: 2201 - protein, 9 aa, Artificial Sequence
  candidate mimic peptide
VVPESPRWL

SEQ ID NO: 2202 - protein, 10 aa, Artificial Sequence
  candidate mimic peptide
VVTEAGFGAD

SEQ ID NO: 2203 - protein, 17 aa, Artificial Sequence
  candidate mimic peptide
VVTIMGHVDHGKTTLLD

SEQ ID NO: 2204 - protein, 9 aa, Artificial Sequence
  candidate mimic peptide
VVVGPEAPL

SEQ ID NO: 2205 - protein, 12 aa, Artificial Sequence
  candidate mimic peptide
VVYGITTGFGKF

SEQ ID NO: 2206 - protein, 10 aa, Artificial Sequence
  candidate mimic peptide
VWCSNDYLGM

SEQ ID NO: 2207 - protein, 9 aa, Artificial Sequence
  candidate mimic peptide
VWQTGSGTQ

SEQ ID NO: 2208 - protein, 11 aa, Artificial Sequence
  candidate mimic peptide
VWVDLEMTGLD

SEQ ID NO: 2209 - protein, 11 aa, Artificial Sequence
  candidate mimic peptide
VWVSEVMLQQT

SEQ ID NO: 2210 - protein, 11 aa, Artificial Sequence
  candidate mimic peptide
VYDQMPEPRYV

SEQ ID NO: 2211 - protein, 9 aa, Artificial Sequence
  candidate mimic peptide
VYGITTGFG

SEQ ID NO: 2212 - protein, 9 aa, Artificial Sequence
  candidate mimic peptide
WAHLDIAGV

SEQ ID NO: 2213 - protein, 9 aa, Artificial Sequence
  candidate mimic peptide
WAIGTGKTA

SEQ ID NO: 2214 - protein, 10 aa, Artificial Sequence
  candidate mimic peptide
WAIGTGKTAT

SEQ ID NO: 2215 - protein, 10 aa, Artificial Sequence
  candidate mimic peptide
WAKQGVLLLN

SEQ ID NO: 2216 - protein, 15 aa, Artificial Sequence
  candidate mimic peptide
WAKQGVLLLNAVLTV

SEQ ID NO: 2217 - protein, 11 aa, Artificial Sequence
  candidate mimic peptide
WCISRQLWWGH

SEQ ID NO: 2218 - protein, 14 aa, Artificial Sequence
  candidate mimic peptide
WCISRQLWWGHRIP

SEQ ID NO: 2219 - protein, 15 aa, Artificial Sequence
  candidate mimic peptide
WCISRQLWWGHRIPA

SEQ ID NO: 2220 - protein, 16 aa, Artificial Sequence
  candidate mimic peptide
WCISRQLWWGHRIPAY

SEQ ID NO: 2221 - protein, 17 aa, Artificial Sequence
  candidate mimic peptide
WCISRQLWWGHRIPAYF

SEQ ID NO: 2222 - protein, 9 aa, Artificial Sequence
  candidate mimic peptide
WDLRKTQPY

SEQ ID NO: 2223 - protein, 12 aa, Artificial Sequence
  candidate mimic peptide
WDWVGGRYSLWS

SEQ ID NO: 2224 - protein, 16 aa, Artificial Sequence
  candidate mimic peptide
WDWVGGRYSLWSAIGL

SEQ ID NO: 2225 - protein, 10 aa, Artificial Sequence
  candidate mimic peptide
WDYAHCLPYF

SEQ ID NO: 2226 - protein, 9 aa, Artificial Sequence
  candidate mimic peptide
WIIDPIDGT

SEQ ID NO: 2227 - protein, 9 aa, Artificial Sequence
  candidate mimic peptide
WKKNGWKTS

SEQ ID NO: 2228 - protein, 9 aa, Artificial Sequence
  candidate mimic peptide
WLEVLGCGV

SEQ ID NO: 2229 - protein, 10 aa, Artificial Sequence
  candidate mimic peptide
WLFDCGEGTQ

SEQ ID NO: 2230 - protein, 10 aa, Artificial Sequence
  candidate mimic peptide
WLHVDAAWGG

SEQ ID NO: 2231 - protein, 10 aa, Artificial Sequence
  candidate mimic peptide
WLTGLSGAGK

SEQ ID NO: 2232 - protein, 11 aa, Artificial Sequence
  candidate mimic peptide
WNDMNEPSVFN

SEQ ID NO: 2233 - protein, 11 aa, Artificial Sequence
  candidate mimic peptide
WPMTFGLACCA

SEQ ID NO: 2234 - protein, 16 aa, Artificial Sequence
  candidate mimic peptide
WPMTFGLACCAVEMMH

SEQ ID NO: 2235 - protein, 12 aa, Artificial Sequence
  candidate mimic peptide
WQTGSGTQTNMN

SEQ ID NO: 2236 - protein, 9 aa, Artificial Sequence
  candidate mimic peptide
WRLNERHYG

SEQ ID NO: 2237 - protein, 11 aa, Artificial Sequence
  candidate mimic peptide
WRLNERHYGGL

SEQ ID NO: 2238 - protein, 13 aa, Artificial Sequence
  candidate mimic peptide
WRLNERHYGGLTG

SEQ ID NO: 2239 - protein, 18 aa, Artificial Sequence
  candidate mimic peptide
WRLNERHYGGLTGLNKAE

SEQ ID NO: 2240 - protein, 21 aa, Artificial Sequence
  candidate mimic peptide
WRLNERHYGGLTGLNKAETAA

SEQ ID NO: 2241 - protein, 9 aa, Artificial Sequence
  candidate mimic peptide
WSLLDNFEW

SEQ ID NO: 2242 - protein, 11 aa, Artificial Sequence
  candidate mimic peptide
WSSCNIFSTQD

SEQ ID NO: 2243 - protein, 9 aa, Artificial Sequence
  candidate mimic peptide
WTTTPWTLP

SEQ ID NO: 2244 - protein, 11 aa, Artificial Sequence
  candidate mimic peptide
WTTTPWTLPSN

SEQ ID NO: 2245 - protein, 9 aa, Artificial Sequence
  candidate mimic peptide
WVEPELRGV

SEQ ID NO: 2246 - protein, 10 aa, Artificial Sequence
  candidate mimic peptide
WVGGRYSLWS

SEQ ID NO: 2247 - protein, 10 aa, Artificial Sequence
  candidate mimic peptide
WVLGEHGDSS

SEQ ID NO: 2248 - protein, 10 aa, Artificial Sequence
  candidate mimic peptide
WVQIFENKGA

SEQ ID NO: 2249 - protein, 9 aa, Artificial Sequence
  candidate mimic peptide
WYDNEFGYS

SEQ ID NO: 2250 - protein, 11 aa, Artificial Sequence
  candidate mimic peptide
YAEALREVSAA

SEQ ID NO: 2251 - protein, 11 aa, Artificial Sequence
  candidate mimic peptide
YAEALREVSAA

SEQ ID NO: 2252 - protein, 9 aa, Artificial Sequence
  candidate mimic peptide
YARGAQDMK

SEQ ID NO: 2253 - protein, 9 aa, Artificial Sequence
  candidate mimic peptide
YATRDLAAA

SEQ ID NO: 2254 - protein, 10 aa, Artificial Sequence
  candidate mimic peptide
YATRDLAAAI

SEQ ID NO: 2255 - protein, 10 aa, Artificial Sequence
  candidate mimic peptide
YCGFDPTADS

SEQ ID NO: 2256 - protein, 9 aa, Artificial Sequence
  candidate mimic peptide
YCIVPFTRG

SEQ ID NO: 2257 - protein, 9 aa, Artificial Sequence
  candidate mimic peptide
YCLGPTHEE

SEQ ID NO: 2258 - protein, 9 aa, Artificial Sequence
  candidate mimic peptide
YCTGGIRCE

SEQ ID NO: 2259 - protein, 10 aa, Artificial Sequence
  candidate mimic peptide
YDLTSKPPGT

SEQ ID NO: 2260 - protein, 9 aa, Artificial Sequence
  candidate mimic peptide
YDLVLNGNE

SEQ ID NO: 2261 - protein, 10 aa, Artificial Sequence
  candidate mimic peptide
YGITTGFGKF

SEQ ID NO: 2262 - protein, 11 aa, Artificial Sequence
  candidate mimic peptide
YGITTGFGKFA

SEQ ID NO: 2263 - protein, 9 aa, Artificial Sequence
  candidate mimic peptide
YGPPGTGKT

SEQ ID NO: 2264 - protein, 9 aa, Artificial Sequence
  candidate mimic peptide
YGPPGVGKT

SEQ ID NO: 2265 - protein, 10 aa, Artificial Sequence
  candidate mimic peptide
YGPPGVGKTS

SEQ ID NO: 2266 - protein, 10 aa, Artificial Sequence
  candidate mimic peptide
YICGEETALI

SEQ ID NO: 2267 - protein, 9 aa, Artificial Sequence
  candidate mimic peptide
YIEAHGTGT

SEQ ID NO: 2268 - protein, 9 aa, Artificial Sequence
  candidate mimic peptide
YIGVLIDDL

SEQ ID NO: 2269 - protein, 10 aa, Artificial Sequence
  candidate mimic peptide
YINSPGGVVT

SEQ ID NO: 2270 - protein, 12 aa, Artificial Sequence
  candidate mimic peptide
YINSPGGVVTAG

SEQ ID NO: 2271 - protein, 19 aa, Artificial Sequence
  candidate mimic peptide
YINSPGGVVTAGLAIYDTM

SEQ ID NO: 2272 - protein, 13 aa, Artificial Sequence
  candidate mimic peptide
YITPVPGGVGPMT

SEQ ID NO: 2273 - protein, 10 aa, Artificial Sequence
  candidate mimic peptide
YLDLYLIHWP

SEQ ID NO: 2274 - protein, 11 aa, Artificial Sequence
  candidate mimic peptide
YLRPETAQGIF

SEQ ID NO: 2275 - protein, 9 aa, Artificial Sequence
  candidate mimic peptide
YLVMEYVPG

SEQ ID NO: 2276 - protein, 10 aa, Artificial Sequence
  candidate mimic peptide
YNKDLQEDKE

SEQ ID NO: 2277 - protein, 9 aa, Artificial Sequence
  candidate mimic peptide
YPLNPNGSP

SEQ ID NO: 2278 - protein, 13 aa, Artificial Sequence
  candidate mimic peptide
YQDQKPGTSGLRK

SEQ ID NO: 2279 - protein, 10 aa, Artificial Sequence
  candidate mimic peptide
YQIYPRSFKD

SEQ ID NO: 2280 - protein, 12 aa, Artificial Sequence
  candidate mimic peptide
YQIYPRSFKDSN

SEQ ID NO: 2281 - protein, 9 aa, Artificial Sequence
  candidate mimic peptide
YQRLEFLGD

SEQ ID NO: 2282 - protein, 9 aa, Artificial Sequence
  candidate mimic peptide
YQWYLDLRR

SEQ ID NO: 2283 - protein, 9 aa, Artificial Sequence
  candidate mimic peptide
YRDDGLLVW

SEQ ID NO: 2284 - protein, 10 aa, Artificial Sequence
  candidate mimic peptide
YRIDHYLGKE

SEQ ID NO: 2285 - protein, 11 aa, Artificial Sequence
  candidate mimic peptide
YRKLALKYHPD

SEQ ID NO: 2286 - protein, 14 aa, Artificial Sequence
  candidate mimic peptide
YRLALQTREQHIRR

SEQ ID NO: 2287 - protein, 32 aa, Artificial Sequence
  candidate mimic peptide
YRLALQTREQHIRRDKATSNICTAQALLANMA

SEQ ID NO: 2288 - protein, 9 aa, Artificial Sequence
  candidate mimic peptide
YRQRYLDLI

SEQ ID NO: 2289 - protein, 9 aa, Artificial Sequence
  candidate mimic peptide
YSALKKDGQ

SEQ ID NO: 2290 - protein, 13 aa, Artificial Sequence
  candidate mimic peptide
YSAVNQGHCHPKI

SEQ ID NO: 2291 - protein, 10 aa, Artificial Sequence
  candidate mimic peptide
YTAIEAPKGE

SEQ ID NO: 2292 - protein, 10 aa, Artificial Sequence
  candidate mimic peptide
YTHFTSPIRR

SEQ ID NO: 2293 - protein, 14 aa, Artificial Sequence
  candidate mimic peptide
YTPYQPEVSQGRLE

SEQ ID NO: 2294 - protein, 18 aa, Artificial Sequence
  candidate mimic peptide
YTPYQPEVSQGRLESLLN

SEQ ID NO: 2295 - protein, 10 aa, Artificial Sequence
  candidate mimic peptide
YTRREPLGVC

SEQ ID NO: 2296 - protein, 12 aa, Artificial Sequence
  candidate mimic peptide
YTSGSTGKPKGV

SEQ ID NO: 2297 - protein, 11 aa, Artificial Sequence
  candidate mimic peptide
YTSGSTGMPKG

SEQ ID NO: 2298 - protein, 12 aa, Artificial Sequence
  candidate mimic peptide
YTSGSTGRPKGV

SEQ ID NO: 2299 - protein, 11 aa, Artificial Sequence
  candidate mimic peptide
YTSGTTGLPKG

SEQ ID NO: 2300 - protein, 11 aa, Artificial Sequence
  candidate mimic peptide
YTSGTTGNPKG

SEQ ID NO: 2301 - protein, 12 aa, Artificial Sequence
  candidate mimic peptide
YTSGTTGNPKGV

SEQ ID NO: 2302 - protein, 13 aa, Artificial Sequence
  candidate mimic peptide
YTSGTTGNPKGVM

SEQ ID NO: 2303 - protein, 9 aa, Artificial Sequence
  candidate mimic peptide
YTSVLKRAI

SEQ ID NO: 2304 - protein, 12 aa, Artificial Sequence
  candidate mimic peptide
YTSVLKRAIRTL

SEQ ID NO: 2305 - protein, 13 aa, Artificial Sequence
  candidate mimic peptide
YTSVLKRAIRTLW

SEQ ID NO: 2306 - protein, 9 aa, Artificial Sequence
  candidate mimic peptide
YVEGESLLM

SEQ ID NO: 2307 - protein, 11 aa, Artificial Sequence
  candidate mimic peptide
YVGCGERGNEM

SEQ ID NO: 2308 - protein, 10 aa, Artificial Sequence
  candidate mimic peptide
YVHRIGRTGR

SEQ ID NO: 2309 - protein, 12 aa, Artificial Sequence
  candidate mimic peptide
YVHRVGRTARAG

SEQ ID NO: 2310 - protein, 13 aa, Artificial Sequence
  candidate mimic peptide
YVNDAFGTAHRAH

SEQ ID NO: 2311 - protein, 9 aa, Artificial Sequence
  candidate mimic peptide
YVYIIYGMY

SEQ ID NO: 2312 - protein, 9 aa, Artificial Sequence
  candidate mimic peptide
YWHFVDVVW

SEQ ID NO: 2313 - protein, 14 aa, Artificial Sequence
  candidate mimic peptide
YWLSGLTCTEQNFI

SEQ ID NO: 2314 - DNA, 669 bp, Artificial Sequence
  RFP gene
atggaggacgttatcaaagagttcatgcgtttcaaagttcgtatggaaggtagcgttaacggtcacgagttcgaaatcgaaggtgagggtgaaggtcgtccgtacgaaggtactcaaaccgctaaactgaaagttaccaaaggtggccctctgccgttcgcttgggacatcctgtccccgcagttccagtacggtagcaaggcttacgttaaacatccggctgacattccggactacttaaagctgtcctttccggaaggtttcaaatgggagcgtgttatgaacttcgaggacggcggtgttgttaccgttacgcaggactcctccctgcaagacggtgagttcatctacaaagttaaactgcgtggtacgaacttcccgtccgacggcccggttatgcagaaaaaaactatgggttgggaggcttccaccgaacgtatgtatccggaggacggtgcgctgaaaggtgaaatcaaaatgcgtctgaaactgaaagacggcggtcactacgacgcggaagttaaaactacctacatggctaaaaaacctgttcaactgccgggcgcttacaaaaccgacatcaaactggacatcacctcccacaacgaggactataccatcgttgaacagtacgaacgcgcggaaggtcgtcactccactggtgcttaa

SEQ ID NO: 2315 - DNA, 12822 bp, Artificial Sequence
  Payload encoding prime editor (PE) and pegRNA targeting RFP
gtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaactactagaagagcgattgggctcttcaatggataagaaatacagcataggcttagacatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgacgccattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgactcgggcggctccagcgggggcagcagcggctcggaaactcccggcacatctgagtctgccacccccgaatcgagtggtggaagctccggcggctcgtcaactctgaacatcgaagacgagtaccgtcttcatgagacgagcaaagagcctgacgtctccttagggtcaacatggttatctgactttccgcaggcgtgggctgagacaggcgggatggggctggcagttcgtcaagcaccgttaattattccactgaaagcgacctctactccggtatctattaaacaataccccatgagtcaggaagcgcgtttaggtatcaagccccatattcagcgcctgttagatcaaggaatccttgtcccatgccagagcccgtggaataccccccttctgccagtgaagaaaccgggtacgaatgactaccgccctgtgcaggacttgcgtgaagtaaacaagcgcgtagaggatattcaccctactgtaccaaacccttataatttattaagcggtttacctccgtcgcatcagtggtatactgttttagatttaaaggacgcgtttttttgtctgcgtttgcaccctacaagccagccccttttcgcctttgagtggcgcgaccccgaaatgggaattagcggtcaactgacttggacccgtctgcctcagggatttaaaaattccccaacgcttttcaatgaagcgctgcatcgtgatttggcggattttcgcattcaacacccagatctgattctgctgcaatacgtggatgacttgcttttggcggcgacaagcgagttggactgccaacaaggcacacgtgcccttttgcagaccttaggaaacctgggatatcgtgcttcggcgaagaaagcacaaatttgccaaaaacaggtgaagtatctgggatacctgcttaaagaggggcaacgttggttaacggaagcccgcaaagaaaccgtaatgggtcagcctacgcctaagactccccgtcagcttcgcgagtttttgggaaaggcgggattttgccgtttatttattccagggtttgccgagatggctgcgccattgtacccgttgactaagcccggcacgctgttcaactgggggcccgaccaacaaaaagcataccaagagattaaacaagcattattgactgcgcccgcgttagggctgccagatttgaccaaaccttttgaattgttcgtcgatgaaaagcaggggtatgccaaaggggtacttacccagaaattaggaccgtggcgtcgcccagtggcttatttgtccaaaaaattggatccagtggcagcgggttggcccccatgcttgcgtatggtagccgcaatcgccgtgttaacaaaggatgccggaaaattgactatgggtcagccgctggtgattttagctccacatgcagtcgaggctcttgttaaacaacctccagaccgttggctgagtaatgcacgcatgacacactaccaggccttacttttggacactgatcgtgtgcagtttggacctgtggtagcccttaacccggcaaccctgttaccacttcctgaagaggggctgcaacataactgtttagacatccttgctgaagctcacggaactcgcccagatcttactgatcaacctcttcccgatgccgaccatacttggtatacggatggctcgtcgttgctgcaagaaggtcagcgtaaagctggagccgctgtcacgaccgaaacggaggttatttgggcgaaagctttgccagcgggaactagcgcccagcgcgcagagttaatcgcgttgactcaagctctgaagatggcggagggtaaaaaactgaacgtgtacaccgatagccgttacgctttcgcgacggcccatattcatggggaaatctatcgccgccgtggttggctgacgtccgagggcaaggaaatcaaaaacaaggatgagatcttagcgttacttaaggctttattcttgcccaagcgtctttcaatcattcattgcccgggacatcaaaagggccactccgcagaggcgcgtggcaatcgcatggcggatcaagcggcgcgtaaagccgctatcacagaaacgcccgatacgtctactctgctgattgagaactcgtcgccatcggggggatctaagcgtacggcggacggctcagagtttgagtaatgtatgcttaagcagctcggtaccaaagacgaacaataagacgctgaaaagcgtcttttttcgttttggtcctgttgcggcgcgatagtgtgaacatgctatagacttctggtgctacccgactgacaattaatcatccggctcgtataatgctagccgtttcaaagttcgtatggagttttagagctagaaatagcaagttaaaataaggctagtccgttatcaacttgaaaaagtggcaccgagtcggtgctaacgctaccttacatacgaactttgaaactttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtaggcgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaa

SEQ ID NO: 2316 - protein, 504 aa, Escherichia coli
MTIMEHVSIKTLYHLLCCMLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 2317 - DNA, 1515 bp, Escherichia coli
atgacaataatggaacacgttagcattaaaacattatatcatctcctgtgctgtatgctgctctttatttccgctatgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgagtaa

SEQ ID NO: 2318 - protein, 300 aa, Escherichia coli
MKRVITLFAVLLMGWSVNAWSFACKTANGTAIPIGGGSANVYVNLAPVVNVGQNLVVDLSTQIFCHNDYPETITDYVTLQRGSAYGGVLSNFSGTVKYSGSSYPFPTTSETPRVVYNSRTDKPWPVALYLTPVSSAGGVAIKAGSLIAVLILRQTNNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 2319 - DNA, 903 bp, Escherichia coli
atgaaacgagttattaccctgtttgctgtactgctgatgggctggtcggtaaatgcctggtcattcgcctgtaaaaccgccaatggtaccgctatccctattggcggtggcagcgccaatgtttatgtaaaccttgcgcccgtcgtgaatgtggggcaaaacctggtcgtggatctttcgacgcaaatcttttgccataacgattatccggaaaccattacagactatgtcacactgcaacgaggctcggcttatggcggcgtgttatctaatttttccgggaccgtaaaatatagtggcagtagctatccatttcctaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccgtggttcagtgccaattcctcttaccgtttattgtgcgaaaagccaaaacctggggtattacctctccggcacacacgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtgagtctgggattaacggcaaattatgcacgtaccggagggcaggtgactgcagggaatgtgcaatcgattattggcgtgacttttgtttatcaataa

SEQ ID NO: 2320 - protein, 177 aa, Escherichia coli
MRLLPLVAAATAAFLVVACSSPTPPRGVTVVNNFDAKRYLGTWYEIARFDHRFERGLEKVTATYSLRDDGGLNVINKGYNPDRGMWQQSEGKAYFTGAPTRAALKVSFFGPFYGGYNVIALDREYRHALVCGPDRDYLWILSRTPTISDEVKQEMLAVATREGFDVSKFIWVQQPGS

SEQ ID NO: 2321 - DNA, 534 bp, Escherichia coli
atgcgcctgctccctctcgttgccgcagcgacagctgcatttctggtcgttgcctgcagttctcctacgccgccgcgtggcgtgaccgtagtaaataatttcgacgccaaacgttatctcggtacctggtatgagattgcccgttttgatcaccgctttgaacgtggactggaaaaagtcaccgcaacatacagcctgcgtgatgacggcggcctgaatgtcattaataaaggctataaccctgacagaggaatgtggcagcagagtgaagggaaagcgtactttaccggcgcaccaactcgcgctgcgctgaaagtgtcattctttggtcctttctatggcggttataacgttattgcactcgatcgggaataccgccatgcgctggtttgcgggccggaccgcgactacctgtggatactctcccgcacgccaaccatttctgacgaagtgaaacaggagatgctggcagtcgcgacccgggaagggtttgatgtcagtaaatttatttgggtacagcagcctggtagttag

SEQ ID NO: 2322 - protein, 1022 aa, Bacteroides thetaiotaomicron
MKLKKRTFLILMAALTATFASAQKQPLPEWQSQYAVGLNKLAPHTYVWPYADASDIGKPGGYEQSPYYMSLNGKWKFNWVKNPDNRPKDFYQPSYYTGGWADINVPGNWERQGYGTAIYVNETYEFDDKMFNFKKNPPLVPFAENEVGSYRRTFKVPADWKGRRVVLCCEGVISFYYVWVNGKLLGYNQGSKTAAEWDITDVLSEGENVVALEVYRWSSGAYLECQDMWRLSGIERDVYLYSTPKQYIADYKVSASLDKEKYKEGIFNLEVTVEGPSATASSIAYTLKDASGKAVLQDAINIKSRGLSNFIAFDEKKIAEVKAWNAEHPNLYTLVLELKDAQGKVTELTGCEVGFRTSEIKDGRFCINGVPVLVKGTNRHEHSQLGRTVSKELMEQDIRLMKQHNINMVRNSHYPTHPYWYQLCDRYGLYMIDEANIESHGMGYGPASLAKDSTWLTAHMDRTHRMYERSKNHPAIVIWSQGNEAGNGINFERTYDWLKSVEKGRPVQYERAELNYNTDIYCRMYRSVDEIKAYVGKKDIYRPFILCEYLHAMGNSCGGMKEYWEVFENEPMAQGGCIWDWVDQNFREIDKDGKWYWTYGGDYGPEGIPSFGNFCGNGLVNAVREPHPHLLEVKKIYQNIKATLSDRKNLKVCIKNWYDFSNLNEYILRWNVKGEDGTVLAEGTKEVDCEPHATVDVTLGAVKLPNTVREAYLNLSWSRKEATPLVDTDWEVAYDQFVLAGNKNTTAYRPQKAGETAFVVDKNTGALSSLTLDGKELLAAPITLSLFRPATDNDNRDRNGARLWRKAGLNNLTQKVVSLKEEKTSATVRAEILNGKGQKVGMADFVYALDKNGALKVRTTFQPDTAIVKSMARLGLTFRMADAYNQVSYLGRGDHETYIDRNQSGRIGLYDTTVERMFHYYATPQSTANRTDVRWAKLTDQAGEGVFMESNRPFQFSIIPFSDVLLEKAHHINELERDGMITIHLDAEQAGVGTATCGPGVLPQYLVPVKKQSFEFTLYPVK

SEQ ID NO: 2323 - DNA, 3069 bp, Bacteroides thetaiotaomicron
atgaaattaaagaaacgaacgtttttaatcttgatggcagcactgactgctaccttcgcttcggctcagaaacagcctttgccggagtggcagagccagtatgcggtaggactgaataaactcgctcctcatacctatgtatggccttacgccgacgcttccgatattggaaagccgggaggatatgaacagtctccttattatatgagtctgaacgggaagtggaaatttaactgggtgaagaacccggacaaccgtccgaaggacttttaccagccctcttattataccggagggtgggcggatattaatgttcccggcaactgggaacggcaaggctacggaacagctatctatgtcaacgaaacttatgagtttgacgacaagatgttcaacttcaagaagaatccgccattggttccatttgctgagaatgaagtaggttcttatcgtcgcacgtttaaggtgcctgccgactggaaaggacgtcgggtagtgctctgctgcgaaggagtgatctctttctattatgtatgggtgaacggaaagttgcttggctataatcagggatcgaagacggctgccgaatgggacattaccgatgtactgagtgaaggagagaatgtggtagctctggaagtatatcgctggagttcgggtgcttatctggaatgtcaggatatgtggcgtctgagtggcatcgaacgggatgtttatctgtatagcactcccaaacagtatattgctgactataaagtaagtgcttcccttgataaagagaaatacaaagaaggtatcttcaatctggaagtgacggtggaaggcccttctgctactgccagctctatcgcttatacactgaaggatgcttccggaaaggcagtattgcaggatgccattaacatcaagtcccgtggactgagtaactttatcgctttcgatgagaagaagattgcagaagtaaaagcatggaatgcggagcatcctaacctttataccttggtactcgaattaaaagatgcgcaaggaaaagtaaccgaactgaccggttgtgaagtcggtttccgtacttcggaaatcaaggacggacgtttctgtattaacggtgttccggtgctggtgaaagggacgaaccgtcacgaacattcgcaactgggacgtaccgtaagcaaagaactgatggaacaggatatccgcctgatgaaacagcataatatcaacatggtgcgtaactcacattatccgactcatccgtactggtatcagctttgcgaccgctacgggctgtatatgattgatgaggcgaatatcgaatcgcatggcatgggatacgggcctgcctcccttgccaaagacagtacttggctgaccgctcacatggaccgtacacaccgtatgtacgaacgttccaagaatcatccggctatcgtgatctggtcacagggcaatgaagccggcaacggcatcaacttcgaacgtacttacgactggctgaaatcggtagagaaaggccgtcccgtgcaatatgaacgtgctgaactgaattacaacacggacatctattgccgtatgtaccgcagtgtggacgaaattaaggcatacgtgggtaagaaggatatttaccgtcctttcattctttgcgaatatctgcacgctatgggtaacagttgcggtggaatgaaagaatactgggaagtctttgaaaatgagccgatggcacaagggggctgcatttgggactgggtggatcagaacttccgtgaaatagacaaagacggaaaatggtactggacttatggaggcgattacggaccggaaggaatccccagcttcggtaatttctgtggcaacggtctggtgaatgctgttcgtgaaccgcatccgcatctactcgaagtgaagaaaatatatcagaacatcaaagcgactttgtcagaccggaagaatctgaaagtctgcataaagaactggtatgacttttctaatctgaatgaatatatcctgcgttggaatgtgaaaggggaggatggaaccgtacttgccgaaggcacgaaggaagtagactgcgagccgcacgctacggtagatgtcactttgggtgccgtcaaacttccgaataccgttcgggaagcctatctgaacctaagctggagccgtaaagaggccactccgctagtggataccgactgggaagtggcatacgaccagtttgtacttgccggtaataagaatacgacggcttatcgtccgcagaaggcgggagaaacagcttttgttgtggacaagaataccggggcactttcttccctgactttggatggaaaggaattgctggctgcaccaatcactttgagcctgttccgtccggctacggataatgataaccgggataggaacggagcccgtctgtggcgcaaggcaggtttgaacaatctgacacagaaagtggtgtcactgaaagaagaaaagacatcggcaacggtccgtgctgagattcttaatgggaaaggacagaaagtaggaatggcggattttgtttatgcactcgacaagaacggggcattgaaggttcgcaccaccttccagccggatacggcgattgtgaagtcgatggctcgtctggggctgaccttccgcatggcagatgcttataatcaagtatcttatctgggacgtggcgatcatgaaacgtatatcgaccgcaaccagtccggtaggataggactgtatgatacgacggtagaacggatgttccactattacgctaccccacaatctacagctaaccggacagatgtacgctgggcgaaactgacggatcaggcaggcgaaggtgtctttatggaatcgaatcgtcctttccagtttagtatcattcctttctcggatgtattattagagaaggcgcaccacattaatgaactggagcgtgacggaatgataactatacatctggatgccgaacaggcaggagtaggtacggctacctgcggaccgggtgtattgccgcaatatctggtaccggtgaaaaagcagagttttgaatttacgctttatccggtaaaatag

SEQ ID NO: 2324 - protein, 18 aa, Artificial Sequence
  MYH6 614-629
RSLKLMATLFSTYASADR

SEQ ID NO: 2325 - DNA, 12861 bp, Artificial Sequence
  Payload encoding prime editor (PE) and pegRNA targeting RFP and containing an inducible promoter
gtccccgaatctgtcgggctatttcactaatactttccaaacgccccgtatccaagaagaacgaatttatccacgctcccgtctttgggacgaataccgctacaagtggacagaggatcggtacgggcctctaataaatccaacactctacgccctcttcaagagctagaagaacagggtgcagttggaaagggaattatttcgtaaggcgagccaataccgtaattaattcggaagagttaacacgattggaagtaggaatagtttctaaccacggttactaatcctaataacggaacgctgtctgatagattagtgtcagcgctcggtaccaaagaaaaataaaaagacgctgaaaagcgtctttttatttttcggtccagtgtaactcaggcaaaagcacgtaatattcgtactttcttcctccgtaagcgtcacccacattccttaaagagtgcatgtgcatattttgttatcaataaaaaaggccgcgatttgcggccttattgttcgtcttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccacggattggcactgacgaaaaacatattttcgataaaccctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtcggaatgacaaatggttccaattattgaacacccttcggggtgtttttttgtttctggtttcccgaggccggcctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcaccggcgcgccgtgaccaattattgaaggccgctaacgcggcctttttttgtttctggtatcccgaatggagcgacttctccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtaaagggtaagtatgaaggtcgtgtactccatcgctaccaaattccagaaaacagacgctttcgagcgtcttttttcgttttggtcacgacgtacggtggaagattcgttaccaattgacagctagctcagtcctaggtatatacatacatgcttgtttgtttgtaaactacggagatttataagcaggaagtggctatggataagaaatacagcataggcttagacatcggcacaaatagcgtcggatgggcggtgatcactgatgaatataaagttccgtctaaaaagttcaaggtactgggtaatacagatcgccatagtatcaaaaagaacttaatcggtgcgcttctgttcgattccggcgaaaccgcagaagcaacacgtctgaaacgcaccgctcgtcgccgttacacccgtcgtaaaaaccgcatctgctacctgcaagaaatcttctctaacgaaatggctaaagtagatgacagcttttttcaccgtctggaagaatcatttctggtggaagaagataaaaagcacgaacgtcatccaatcttcggcaacattgtggacgaagtagcgtatcacgaaaaatacccgactatctatcacctgcgcaaaaagctggtcgattcgacggataaggccgatctgcgtctgatctatctggccttagcgcatatgattaagttccgtggtcatttcctgatcgaaggcgacctgaatccagacaacagcgatgtagacaaactgttcatccagctggtgcaaacctataaccagctgtttgaagaaaacccaattaatgctagcggtgttgacgcgaaagcgatcttgtccgcacgcctgtccaaatcccgtcgtctggaaaacttaattgcgcaactgccgggtgagaagaaaaacggactgttcggcaatctgatcgctcttagcttgggactgaccccgaacttcaaaagcaacttcgatctggcagaggacgcaaaacttcaacttagcaaagatacgtatgacgatgacttggataacttactggcccagatcggagatcagtacgctgatctgtttctggcggcaaagaacttatcagacgctattctcctgtctgatattcttcgtgtgaataccgaaatcaccaaagcaccgctttctgcatccatgattaaacgctatgacgaacatcaccaagatctgactcttctgaaagcgctggtacggcaacaactgccggagaagtacaaggagatcttctttgaccaatccaaaaacggctacgcgggttatattgacgggggtgcaagccaagaggagttctacaaattcatcaagccaatcttagaaaaaatggatggcacggaagaattacttgttaaactgaatcgtgaggatctgcttcgtaaacagcgtaccttcgacaacggtagcattccgcaccagatccacttaggtgaactgcacgctatcctgcgtcgccaagaggatttttacccgttcctgaaagataatcgtgaaaaaatcgaaaaaatcctgacctttcgtatcccgtattatgtcggcccgctggcgcgtggcaactcccgtttcgcgtggatgactcgcaaatccgaagaaactattaccccgtggaacttcgaggaagtggttgacaaaggcgcaagcgcccaatccttcatcgagcgcatgactaactttgataaaaacctgccgaacgaaaaggtactgccgaaacactcccttctgtacgaatacttcaccgtgtacaacgagctgactaaagtaaagtatgtgactgagggcatgcgtaaacctgcattcctgagcggtgaacagaaaaaagcaattgttgatttactgtttaaaaccaaccgtaaagtaaccgttaaacagctgaaagaggactacttcaagaaaatcgaatgcttcgactccgtcgagattagtggagttgaagatcgttttaatgcaagtttaggcacgtatcacgatttattaaagatcattaaagacaaagatttcttggacaacgaagaaaatgaggacatcttagaggacatcgtcctgaccctgactctgttcgaagatcgtgaaatgattgaagaacgccttaagacgtatgctcacctgtttgacgataaagtaatgaaacaactgaaacgtcgccgttatactggctggggccgtctgagccgtaaactgattaacggtatccgtgacaaacagtccggtaaaactattctggacttcctgaaatctgacggcttcgcaaaccgtaacttcatgcaactgattcacgacgattccctgaccttcaaagaggacatccagaaagctcaggtttctggtcaaggtgattctctgcacgagcatatcgccaatttagcaggtagtccggcgatcaaaaaaggtatcctgcaaaccgtgaaagtggtggatgagcttgtgaaagttatgggtcgtcacaaaccggaaaacattgttatcgagatggctcgtgaaaaccaaacgacccagaagggacagaaaaactcccgcgaacgcatgaaacgtatcgaggagggtattaaagaacttggctctcagattctgaaagaacaccctgttgaaaatacccaactgcaaaatgaaaaactgtacctgtactacctgcaaaatggtcgtgacatgtatgtagatcaggagctggacatcaaccgcctctccgattacgacgttgacgccattgttccgcagtcttttctgaaagatgattccattgataacaaagtactcacccgtagcgataaaaaccgtgggaagagtgacaacgttccatcggaagaagtagttaagaaaatgaagaactattggcgtcaactgcttaacgcgaaactgattactcaacgtaaatttgataacctgaccaaagctgaacgtggcggtttgtctgagctggataaggcgggttttattaaacgtcaactggtagaaactcgccagattacaaaacatgttgctcagattctggactctcgtatgaacactaaatacgatgaaaatgacaaactgatccgcgaagttaaggttattaccctgaaatctaagctggtttccgacttccgtaaagatttccaattctataaagtgcgcgagattaacaactatcaccacgcgcacgacgcatatctgaatgcagttgttggcacggcactgatcaaaaaatatccgaaactggaaagcgaatttgtgtacggcgattataaagtttacgacgtgcgcaaaatgatcgccaaatctgaacaggaaattggcaaagcaaccgctaaatactttttctactcaaacattatgaatttcttcaaaaccgaaatcaccttagcgaatggcgaaattcgtaaacgccctctgatcgaaaccaacggcgaaacgggtgagatcgtgtgggacaaaggtcgtgatttcgctactgtccgcaaagttctgtccatgcctcaagtaaacatcgttaaaaagactgaggtacagactggcggtttcagcaaggaatccattctgccgaaacgcaactccgacaaactgatcgcgcgtaagaaagactgggatccgaagaaatacggtggcttcgattctccaaccgtggcatacagcgttctggtagtcgccaaagtcgaaaagggtaaatcaaaaaaactgaaatcagtgaaagaacttttaggcatcaccattatggaacgtagctctttcgaaaaaaacccgattgacttcctcgaagcgaaggggtacaaggaagtaaagaaagatctgattatcaaactgccgaagtattccctgttcgaactggaaaatggtcgtaaacgtatgttagcgtctgcgggtgaactgcaaaaagggaacgaattggcccttccgtccaagtacgtgaacttcctgtatctggcctcgcactacgagaaactgaaaggtagtccggaagataatgagcagaaacagctgttcgtggaacagcacaaacactatctggacgagattattgaacagatttctgagtttagcaaacgcgtaattctggcggacgcgaatctggataaagtcctgagcgcctacaataaacaccgtgataaaccgatccgtgaacaggcagaaaacatcattcacctgttcacgctgactaatcttggtgctccggcagccttcaaatacttcgacaccacgatcgatcgtaaacgttacacctccactaaagaagtcttagatgcaactcttattcaccagagcatcactggcctgtatgaaactcgtattgatctgagtcagttgggcggtgactcgggcggctccagcgggggcagcagcggctcggaaactcccggcacatctgagtctgccacccccgaatcgagtggtggaagctccggcggctcgtcaactctgaacatcgaagacgagtaccgtcttcatgagacgagcaaagagcctgacgtctccttagggtcaacatggttatctgactttccgcaggcgtgggctgagacaggcgggatggggctggcagttcgtcaagcaccgttaattattccactgaaagcgacctctactccggtatctattaaacaataccccatgagtcaggaagcgcgtttaggtatcaagccccatattcagcgcctgttagatcaaggaatccttgtcccatgccagagcccgtggaataccccccttctgccagtgaagaaaccgggtacgaatgactaccgccctgtgcaggacttgcgtgaagtaaacaagcgcgtagaggatattcaccctactgtaccaaacccttataatttattaagcggtttacctccgtcgcatcagtggtatactgttttagatttaaaggacgcgtttttttgtctgcgtttgcaccctacaagccagccccttttcgcctttgagtggcgcgaccccgaaatgggaattagcggtcaactgacttggacccgtctgcctcagggatttaaaaattccccaacgcttttcaatgaagcgctgcatcgtgatttggcggattttcgcattcaacacccagatctgattctgctgcaatacgtggatgacttgcttttggcggcgacaagcgagttggactgccaacaaggcacacgtgcccttttgcagaccttaggaaacctgggatatcgtgcttcggcgaagaaagcacaaatttgccaaaaacaggtgaagtatctgggatacctgcttaaagaggggcaacgttggttaacggaagcccgcaaagaaaccgtaatgggtcagcctacgcctaagactccccgtcagcttcgcgagtttttgggaaaggcgggattttgccgtttatttattccagggtttgccgagatggctgcgccattgtacccgttgactaagcccggcacgctgttcaactgggggcccgaccaacaaaaagcataccaagagattaaacaagcattattgactgcgcccgcgttagggctgccagatttgaccaaaccttttgaattgttcgtcgatgaaaagcaggggtatgccaaaggggtacttacccagaaattaggaccgtggcgtcgcccagtggcttatttgtccaaaaaattggatccagtggcagcgggttggcccccatgcttgcgtatggtagccgcaatcgccgtgttaacaaaggatgccggaaaattgactatgggtcagccgctggtgattttagctccacatgcagtcgaggctcttgttaaacaacctccagaccgttggctgagtaatgcacgcatgacacactaccaggccttacttttggacactgatcgtgtgcagtttggacctgtggtagcccttaacccggcaaccctgttaccacttcctgaagaggggctgcaacataactgtttagacatccttgctgaagctcacggaactcgcccagatcttactgatcaacctcttcccgatgccgaccatacttggtatacggatggctcgtcgttgctgcaagaaggtcagcgtaaagctggagccgctgtcacgaccgaaacggaggttatttgggcgaaagctttgccagcgggaactagcgcccagcgcgcagagttaatcgcgttgactcaagctctgaagatggcggagggtaaaaaactgaacgtgtacaccgatagccgttacgctttcgcgacggcccatattcatggggaaatctatcgccgccgtggttggctgacgtccgagggcaaggaaatcaaaaacaaggatgagatcttagcgttacttaaggctttattcttgcccaagcgtctttcaatcattcattgcccgggacatcaaaagggccactccgcagaggcgcgtggcaatcgcatggcggatcaagcggcgcgtaaagccgctatcacagaaacgcccgatacgtctactctgctgattgagaactcgtcgccatcggggggatctaagcgtacggcggacggctcagagtttgagtaatgtatgcttaagcagctcggtaccaaagacgaacaataagacgctgaaaagcgtcttttttcgttttggtcctgttgcggcgcgatagtgtgaacatgctatagacttctggtgctacccgagttggctgagcgcgggtgagagggattcgttaccaatagacaattgattggacgttcaatataatgctagcacgtttcaaagttcgtatggagttttagagctagaaatagcaagttaaaataaggctagtccgttatcaacttgaaaaagtggcaccgagtcggtgctaacgctaccttacatacgaactttgaaactttttttaatccattcgaatcacgtccgacgaacaataaggcctccctaacggggggccttttttattgataacaaaagtaacttcgagcttgtctacctcctagcaccattattgcaattaataaacaactaacggacaattctacctaacagttttcatatatgacgagcagttaagtgatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacagaagaacggtatcaaagctaacttcaaaattcgccataacgttgaagatggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagacgaacaataaggggagcgggaaaccgctccccttttttattgataacaaaagtaaattgcacgctgatagtctcccaattgcgaaggaccaaaacgaaaaaacaccctttcgggtgtcttttctggaatttggtaccgagtactaggtatcgtgtaagtagcgaaggcccgtacgcgagataaactgctaggcaaccgcgactctacgactggtgctcgatttaatttcgctgacgtaaagaaattatcggcagtgcgtcaactgccgtatctttatcttaattaggtagttggacaagcccttgaaagaaatagcaagagcctgcctctctattgaagtcacggcgaaagtcgggtagaaatcaaagaaagcagaaattaaatcggagtaacactaaggtgggataactccgtaactgactacgcctttctctagactttacttgaccagatacactgtctttgacacgttgaaggattagagcaatcaaatccaagactggctaagcacgaagcaactcttgagtgttaaaaagttatctcctgtattcgggaagcgggtactagaagattgcagggactccgacgttaagtaaattacaaagtaataagtatcgttcaggatcacgttaccgcaataagaagcgagaataatataatttccgaagtgcttaccccagtagtgactattcctataacccttctgagtgtccggaggcggaaatttgccacgaaagagaaagtatttccccgacaataataaaggggcgctcctcagcttttccacttggttgggtaagctaggcaactctgaaaggagtttcggcgaattgaagccgacagctttgaattgttttaggggcgttattcgagggcaatcggagctaacttcaagactacttctttgttgaatactaaatagtgcaaaggtcgtgtttcctcaaggatactccgctaacaatataggattccaatcagattcagcactggcggtacgggtgttgcggtgaggcgttcgggtttacggctcgaagctagcacggtaggcgcaggataagtaaggggagtaagtgatcgaacgaatcagaagtgacaatatacttaggctggatctcgtcccgtgaatcccaaccctcaccaactacgagataagaggtaagccaaaaatcgacttggtggcgaccaacgactgttccccccctgtaactaatcgttccgtcaaaacctgacttacttcaaggccaattccaagcgcaaacaataccgtcctagttcttcggttaagtttccgaagtaggagtgagcctacctccgtttgcgtcttgttaccactgacccagctatttactttgtattgcctgcaatcgaatttctgaactctcagatagtggggataacgggaaagttcctatatttgcgaactaacttagccgtccacctcgaagctacctactcacacccaccccgcgcggggtaaataaggcactaatcccagctgagagctggcgtagcacttagccacaagttaattaacagttgtctggtagtttggcggtattaggaagatcctagaagcaaggcagagttagttctaacctaaagccacaaataagacaggttgccaaagcccgccggaaattaaatcttgctcagttcggtaacggagtttccctcccgcgtacttaattcccaataagaaacgcgcccaagtcctatcaggcaaaattcagccccttcccgtgttagaacgagggtaaaaatacaagccgattgaacaagggttgggggcttcaaatcgtcgtttaccccactttacaacggagattaagtagttcaccctatagtacgaagcagaactatttcgaggggcgtgcaataatcgaatcttctgcggttgacttaacacgctagggacgtgccctcgattcaatcgaaggtactcctactcagactgcctcacacccagctagtcactgagcgataaaattgacccgccctctagggaagcgagtacgtcccaaagggctccggacagggctatataggagagtttgatctcgccccgacaactgcaaccctcaactcccttagataatattgttagccgaagttgcacgacccgccgtccacggactgctcttagggtgtggctccttaatctgacaacgtgcaacccctatcgaagtcgattgtttctgcgaaaggtgttgtcctaatagtcccgaaatttggcccttgtaggtgtgaaaccacttagcttcgcgccgtagtcctaaaggcccacctattgactttgtttcgggtagcactaggaatcttaacaatttgaatttggacgtggaacgcgtacaccttaatctccgaataattctagggatttggaagtcctctacgttgacacacctacactgctcgaagtaaatatacgaataacgcgggcctcgcggagccgttccgaatcgtcacgtgttcgtttactgttaattggtggcaaataagcaatatcgtagtccgtcaggcccagccctgttatccacggcgttatttgtcaaattgcgtagaactggattgactgcctgacaatacctaattatcggtacgaa

We claim:

1. A method of modifying a naturally occurring bacteria in situ in a subject comprising:
   administering to the subject a vector in a delivery vehicle, wherein the vector encodes a DNA base editor or a prime editor targeting a specific nucleotide sequence in the bacteria,
   genetically modifying a DNA sequence to generate at least one change in the targeted nucleotide sequence in the naturally occurring bacteria in situ without introducing a double strand break in the DNA sequence,
   wherein said genetic modification does not lead to the death of bacteria.

2. The method of claim 1, wherein the vector encodes the DNA base editor.

3. The method of claim 1, wherein the vector encodes the prime editor.

4. The method of claim 1, wherein said vector is a phagemid.

5. The method of claim 1, wherein said naturally occurring bacteria is involved in a microbiome associated disorder or disease.

6. The method of claim 1, wherein the bacteria with the genetic modification does not have a reduced in vivo growth rate as compared to the same bacteria without the genetic modification.

7. The method of claim 4, wherein the phagemid comprises a nucleic acid sequence encoding a dCas9 (dead-Cas9).

8. The method of claim 4, wherein the phagemid comprises a nucleic acid sequence encoding an nCas9 (nickase Cas9).

9. The method of claim 7, wherein the phagemid comprises a nucleic acid sequence encoding a fusion protein of the dCas9 and a deaminase domain.

10. The method of claim 8, wherein the phagemid comprises a nucleic acid sequence encoding a fusion protein of the nCas9 and a deaminase domain.

11. The method of claim 1, wherein the vector is a packaged phagemid.

12. The method of claim 1, wherein the vector further comprises a conditional origin of replication which is inactive in the targeted naturally occurring bacteria.

13. The method of claim 1, wherein said genetic modification is a point mutation.

14. The method of claim 1, wherein said genetic modification is a point mutation leading to gene disruption.

15. The method of claim 1, wherein the genetic modification is in a bacterial toxin gene.

16. The method of claim 1, wherein the genetic modification is in a DNA sequence coding for an immunogenic component expressed or secreted by the bacteria.

17. The method of claim 1, wherein the genetic modification is a point mutation that results in a change of amino acid in a mimic peptide, wherein said mimic peptide is a bacterial antigen that mimics a human protein.

18. The method of claim 1, wherein the naturally occurring bacteria is *Bacteroides faecis* or *Bacteroides thetaiotaomicron* and the genetic modification is in the *Bacteroides faecis* or *Bacteroides thetaiotaomicron* beta-galactosidase gene.

19. The method of claim 18, wherein the genetic modification in the beta-galactosidase gene results in a change in the amino acid sequence of the beta-galactosidase protein and results in lower identity with human MYH6 cardiac peptide (SEQ ID NO: 2324) as compared to the *Bacteroides faecis* or *Bacteroides thetaiotaomicron* beta-galactosidase protein without the genetic modification, wherein the changed amino acid corresponds to Leu9, Leu11, Met12, Ala13, Leu15, Thr18, Ala20, Ser21, and Ala22 of SEQ ID NO: 2322.

* * * * *